(12) United States Patent
Velculescu et al.

(10) Patent No.: US 7,504,493 B2
(45) Date of Patent: Mar. 17, 2009

(54) CHARACTERIZATION OF THE YEAST TRANSCRIPTOME

(75) Inventors: Victor E. Velculescu, Baltimore, MD (US); Bert Vogelstein, Baltimore, MD (US); Kenneth Kinzler, Bel Air, MD (US)

(73) Assignee: The John Hopkins University, Baltimore, MD (US)

( * ) Notice: Subject to any disclaimer, the term of this patent is extended or adjusted under 35 U.S.C. 154(b) by 758 days.

(21) Appl. No.: 10/915,727

(22) Filed: Aug. 11, 2004

(65) Prior Publication Data

US 2007/0031851 A1 Feb. 8, 2007

Related U.S. Application Data

(63) Continuation of application No. 09/335,032, filed on Jun. 16, 1999, now abandoned, which is a continuation-in-part of application No. 09/012,031, filed on Jan. 22, 1998, now abandoned.

(60) Provisional application No. 60/035,917, filed on Jan. 23, 1997.

(51) Int. Cl.
*C12N 15/11* (2006.01)
(52) U.S. Cl. ........................ 536/24.32; 435/6
(58) Field of Classification Search ........................ None
See application file for complete search history.

(56) References Cited

U.S. PATENT DOCUMENTS 5,556,752 A * 9/1996 Lockhart et al. ................ 435/6

FOREIGN PATENT DOCUMENTS

WO WO 98/32847 7/1998

OTHER PUBLICATIONS

Myers (GenBank® Accession No. G07433, Oct. 6, 1995).*
V.E. Velculescu et al. "Characterization of the yeast transcriptome" Cell, vol. 88, Jan. 24, 1997, pp. 243-251.
K. Nasmyth "Control of the yeast cells cycle by the Cdc28 protein kinase" Current Opinion in Cell Biology, vol. 5, No. 2, Apr. 1993, pp. 166-179.
D.K. Bishop et al. "DMC1: A Meiosis-Specific Yeast Homolog of *E. coli* RECA Required Forrecombination, Synaptonemal Complex Formation, and Cell Cycle Progression" Cell, vol. 69, May 1, 1992, pp. 439-456.
Y. Kyu Jang et al. "Differential expression of the rhp51+ gene, a recaA and RAD51 homolog from the fission yeast Schizosaccharomyces pombe" Gene, vol. 169, 1996, pp. 125-130.
J.H. Toyn et al. "The cell-cycle-regulated yeast gene DBF2, encoding a putative protein kinase, has a homologue that is not under cell-cycle control", Gene, vol. 104, 1991, pp. 63-70.
S.J. Elledge and R.W. Davis "DNA damage induction of ribonucleotide reductase" Mol. Cell. Biol., vol. 9, No. 11, Nov. 1989, pp. 4932-4940.
C. Frankhauser et al. "The *S. pombe* cdc15 gene is a key element in the reorganization of F-actin at mitose" Cell, vol. 82, Aug. 11, 1995, pp. 435-444.
N. Burns et al. "Large-Scale Analysis of Gene Expression, Protein Localization, and Gene Disruption, and Gene Disruption in *Saccharomyces cerecisiae*" Genes and Development, vol. 8, No. May 1, 1994 pp. 1087-1105.
C. Price et al. "A general approach to the isolation of cell cycle-regulated genes in the budding yeast, *Saccharomyces cerevisiae*" J. Mol. Biol, vol. 218, No. 3, Apr. 5, 1991, pp. 543-556.
V.E. Velculescu et al. "Serial Analysis of Gene Expression" Science, vol. 270, Oct. 20, 1995, pp. 484-487.
T. Yasugi and P.M. Howley "Identification of the structural and functional human homolog of the yeast ubiquitin conjugated enzyme UBC9" Nucleotic Acids Research, vol. 24, No. 11, 1996, pp. 2005-2010.
R.M. Goldsteyn et al. "Cell cycle analysis and chromosomal localizationof human Plk1, a putative homologue of the mitotic kinases *Drosophila polo* and *Saccharomyces cerevisiae* Cdc5" J. Cell Science, vol. 107, No. 6, pp. 1509-1517.
M. Schena et al. "Quantitative Monitoring of Gene expression Patterns with a Complementary DNA Microarray" Science, vol. 270, No. 5235, Oct. 20, 1995, pp. 467-470.
D.J. Lockhart et al. "Expression Monitoring by Hybridization to High-Density Oligonucleotide Arrays" Bio/Technology, vol. 14, No. 13, Dec. 1996, pp. 1675-1680.
D. Shalon et al. "A DNA Microarray System for Analyzing Complex DNA Samples Using Two-Color Fluorescent Probe Hybridization" Genome Research, vol. 6, No. 7, Jul. 1, 1996, pp. 639-645.
M. Schena et al. "Paralel human genome analysis: Microarray-based expression monitoring of 1000 genes" Proc. Natl. Acad. Sci., vol. 93, Oct. 1996, pp. 10614-10619.
Goffeau et al., Life with 600 Genes, Oct. 1996, Science, vol. 274 pp. 546-567.
Johnson, Mol. Gen. Genet. 238: 383 (1993).

* cited by examiner

*Primary Examiner*—James Martinell
(74) *Attorney, Agent, or Firm*—Banner & Witcoff, Ltd.

(57) ABSTRACT

Yeast genes which are differentially expressed during the cell cycle are described. They can be used to study, affect, and monitor the cell cycle of a eukaryotic cell. They can be used to obtain human homologs involved in cell cycle regulation. They can be used to identify antifungal agents and other classes of drugs. They can be formed into arrays on solid supports for interrogation of a cell's transcriptome under various conditions.

8 Claims, 5 Drawing Sheets

A

B

| Component | Virtual Rot (SAGE) %mRNA | Copies/cell | Rot (Reassociation) %mRNA | Copies/cell |
|---|---|---|---|---|
| 1 | 17 | 180 | 23 | 200 |
| 2 | 38 | 40 | 51 | 30 |
| 3 | 45 | 2.5 | 26 | 1.5 |

|       | 1 | 2 | 3 |
|-------|---|---|---|
| TDH2/3 | 519 | 561 | 636 |
| TEF1/2 | 396 | 229 | 379 |
| NORF1 | 114 | 84 | 182 |
| RNR4 | 9 | 111 | 7 |
| RNR2 | 9 | 85 | 9 |
| NORF5 | 0 | 49 | 0 |

FIGURE 5

CHARACTERIZATION OF THE YEAST TRANSCRIPTOME

This application is a continuation of application Ser. No. 09/335,032 filed Jun. 16, 1999, now abandoned which is a continuation-in-part of application Ser. No. 09/012,031 filed Jan. 22, 1998, now abandoned, which claimed priority to Ser. No. 60/035,917 filed Jan. 23, 1997.

This application incorporates by reference the sequence listing contained on each of two duplicate compact discs, which are part of the application file. The sequence listing is a 16,601 KB ASCII file named "Attorney Docket 001107.00494 sequence listing.txt," created on Jul. 29, 2004.

This invention was made with government support under CA57345 awarded by the National Institutes of Health. The government has certain rights in the invention.

TECHNICAL FIELD OF THE INVENTION

This invention is related to the characterization of the expressed genes of the yeast genome. More particularly, it is related to the identification and use of previously unrecognized genes.

BACKGROUND OF THE INVENTION

It is by now axiomatic that the phenotype of an organism is largely determined by the genes expressed within it. These expressed genes can be represented by a "transcriptome," conveying the identity of each expressed gene and its level of expression for a defined population of cells. Unlike the genome, which is essentially a static entity, the transcriptome can be modulated by both external and internal factors. The transcriptome thereby serves as a dynamic link between an organism's genome and its physical characteristics.

The transcriptome as defined above has not been characterized in any eukaryotic or prokaryotic organism, largely because of technological limitations. However, some general features of gene expression patterns were elucidated two decades ago through RNA-DNA hybridization measurements (Bishop et al., 1974; Hereford and Rosbash, 1977). In many organisms, it was thus found that at least three classes of transcripts could be identified, with either high, medium, or low levels of expression, and the number of transcripts per cell were estimated (Lewin, 1980). These data of course provided little information about the specific genes that were members of each class. Data on the expression levels of individual genes have accumulated as new genes were discovered. However, in only a few instances have the absolute levels of expression of particular genes been measured and compared to other genes in the same cell type.

Description of any cell's transcriptome would therefore provide new information useful for understanding numerous aspects of cell biology and biochemistry.

SUMMARY OF THE INVENTION

It is an object of the present invention to provide isolated DNA molecules and methods of using such molecules to affect the cell cycle and identify candidate drugs. These and other objects of the invention are achieved by providing the art with one or more of the embodiments described below.

According to one embodiment of the invention an isolated DNA molecule is provided. It comprises a coding sequence of a yeast gene selected from the group consisting of NORF genes comprising a SAGE tag as shown in SEQ ID NOS:67-811.

According to another embodiment of the invention a method of using NORF genes is provided. The method is for affecting the cell cycle of a cell. The method comprises the step of administering to a cell an isolated DNA molecule comprising a coding sequence of a NORF gene whose expression varies by at least 10% between any two phases of the cell cycle selected from the group consisting of log phase, S phase, and G2/M.

In yet another embodiment of the invention a method for screening candidate antifungal drugs is provided. The method comprises the steps of contacting a test substance with a yeast cell and monitoring expression of a NORF gene whose expression varies by at least 10% between any two phases of the cell cycle selected from the group consisting of log phase, S phase, and G2/M, wherein a test substance which modifies the expression of the yeast gene is a candidate antifungal drug.

In still another embodiment of the invention a method for identifying human genes which are involved in cell cycle progression is provided. The method comprises the step of contacting human DNA with a probe which comprises at least 14 contiguous nucleotides of a NORF gene whose expression varies by at least 10% between any two phases of the cell cycle selected from the group consisting of log phase, S phase, and G2/M. A human DNA sequence which hybridizes to the probe is identified as a sequence of a candidate human gene which is involved in cell cycle progression.

The present invention provides probes which comprise at least 14 contiguous nucleotides of a NORF gene comprising a SAGE tag as shown in SEQ ID NOS:67-811.

The invention also provides an array of probes on a solid support. At least one probe in the array comprises at least 14 contiguous nucleotides of a NORF gene comprising a SAGE tag as shown in SEQ ID NOS:67-811.

Still another embodiment of the invention is a method of identifying a candidate drug as a member of a class of drugs having a characteristic effect on gene expression in a yeast cell. A yeast cell is contacted with a candidate drug. Expression of at least one NORF gene whose expression is affected by the class of drugs is monitored in the yeast cell. Detection of a difference in expression of the at least one NORF gene relative to expression in the absence of the candidate drug identifies the candidate drug as a member of the class of drugs.

These and other embodiments of the invention which will be apparent to those of skill in the art upon reading the detailed disclosure provided below, make available to the art hitherto unrecognized genes, and information about the expression of genes globally at the organismal level.

BRIEF DESCRIPTION OF THE DRAWINGS

FIG. 5. Northern Blot Analysis of Representative Genes. TDH⅔, TEF½ and NORF1, are expressed relatively equally in all three states (lane 1, G2/M arrested; lane 2, S phase arrested; lane 3, log phase), while RNR4, RNR2, and NORF5 are highly expressed in S-phase arrested cells. The expression level observed by SAGE (number of tags) is noted below each lane and was highly correlated with quantitation of the Northern blot by PhosphorImager analysis ($r^2$=0.97).

TABLE LEGENDS

Figure 1:
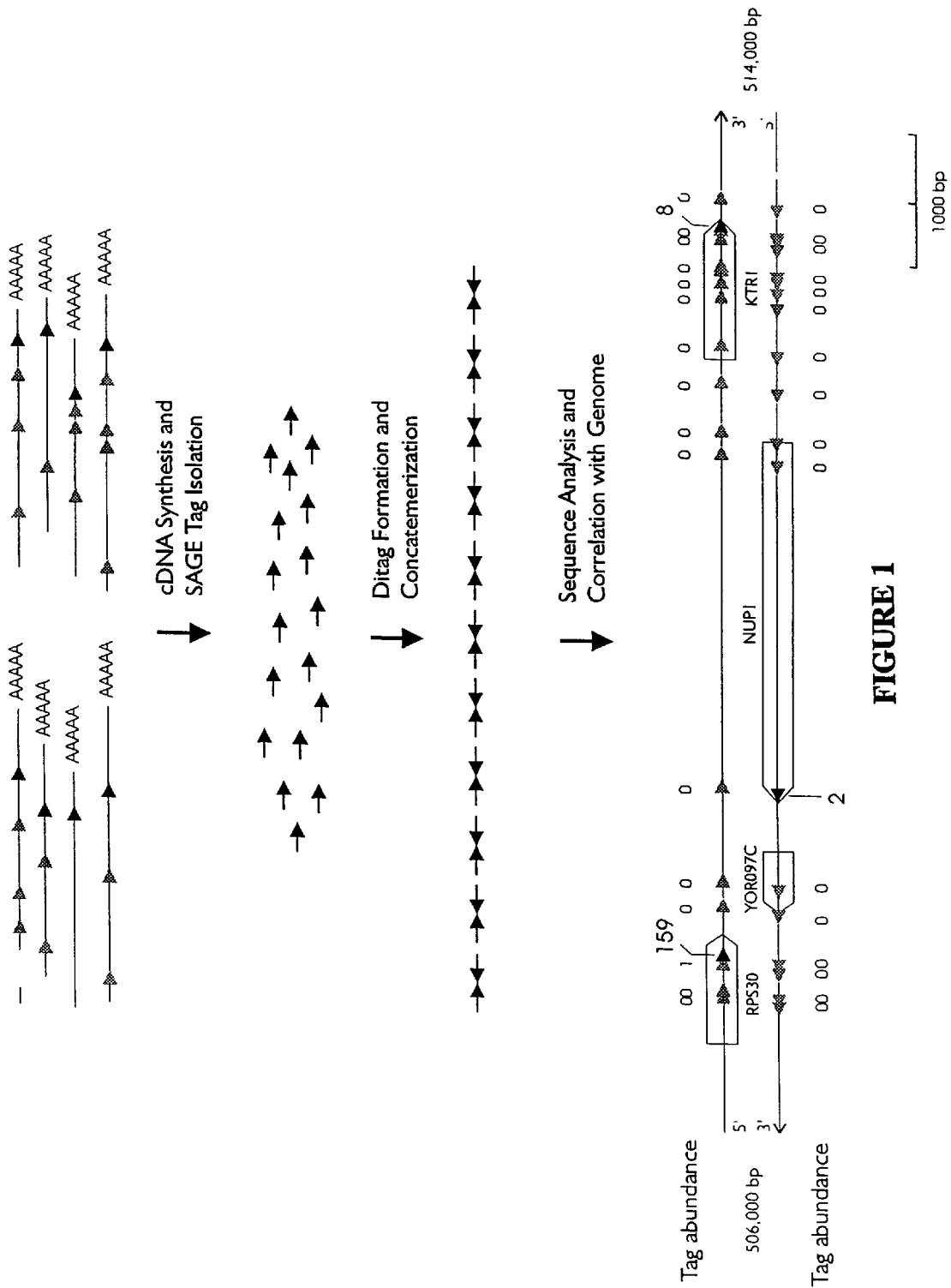
FIG. 1. Schematic of SAGE Method and Genome Analysis. In applying SAGE to the analysis of yeast gene expression patterns, the 3' most NlaIII site was used to define a unique position in each transcript and to provide a site for ligation of a linker with a BsmFI site. The type IIs enzyme BsmFI, which cleaves a defined distance from its non-palindromic recognition site, was then used to generate a 15 bp SAGE tag (designated by the black arrows), which includes the NlaIII site. Automated sequencing of concatenated SAGE tags allowed the routine identification of about a thousand tags per 36-lane sequencing gel. Once sequenced, the abundance of each SAGE tag was calculated, and each tag was used to search the entire yeast genome to identify its corresponding gene. The lower panel shows a small region of Chromosome 15. Gray arrows indicate all potential SAGE tags (NlaIII sites) and black arrows indicate 3' most SAGE tags. The total number of tags observed for each potential tag is indicated above (+ strand) or below (− strand) the tag. As expected, the observed SAGE tags were associated with the 3' end of expressed genes.

Table 1. Highly Expressed Genes. Tag represents the 10 bp SAGE tag adjacent to the NlaIII site; Gene represents the gene or genes corresponding to a particular tag (multiple genes that match unique tags are from related families, with an average identity of 93%); Locus and Description denote the locus name and functional description of each ORF, respectively; Copies/cell represents the abundance of each transcript in the SAGE library, assuming 15,000 total transcripts per cell and 60,633 ascertained transcripts.

Table 2. Expression of Putative Coding Sequences. Table column headings are the same as for Table 1.

Table 3. Expression of the most abundant NORF genes. SAGE Tag, Locus, and Copies/cell are the same as for Table 1; Chr and Tag Pos denote the chromosome and position of each tag; ORF Size denotes the size of the ORF corresponding to the indicated tag. In each case, the tag was located within or less than 250 bp 3' of the NORF.

Table 4. Expression of NORF genes. SAGE tag and Copies/cell are the same as for Table 1. Chr and Tag Pos denote the chromosome and position of each tag.

Table 5. Gene expression changes in different cell cycle phases. L denotes log phase; S denotes synthesis phase; G2/M denotes the mitotic phase. Tag Sequence represents the 10 bp SAGE tag adjacent to the NlaIII site; "ratio L to S" denotes the ratio of expression in log phase to expression in synthesis phase; "ratio S to G2/M" denotes the ratio of expression in synthesis phase to expression in G2/M phase; "ratio G2/M to L" denotes the ratio of expression in G2/M to log phase. #DIV/0! indicates an increase in expression from 0; a value of 0 indicates a decrease in expression to 0; a value of 1 indicates no change; a value less than 1 indicates a decrease in expression; and a value greater than 1 indicates an increase in expression.

Table 6. Intergenic open reading frames that contain or are adjacent to observed SAGE tags. Copies/cell represents abundance of each mRNA transcript as in Table 1. Positive expression level indicates the tag is on the + strand of the chromosome; Negative expression level indicates the tag is on the − strand.

DETAILED DESCRIPTION

It is a discovery of the present invention that certain hitherto unknown genes (the NORFs) exist and are expressed in yeast. These genes, as well as other previously identified and previously postulated genes, can be used to study, monitor, and affect phases of cell cycle. The present invention identifies which genes are differentially expressed during the cell cycle. Differentially expressed genes can be used as markers of phases of the cell cycle. They can also be used to affect a change in the phase of the cell cycle. In addition, they can be used to screen for drugs which affect the cell cycle, by affecting expression of the genes. Human homologs of these eukaryotic genes are also presumed to exist, and can be identified using the yeast genes as probes or primers to identify the human homologs.

New genes termed NORFs (not previously assigned open reading frames) have been found. They are uniquely identified by their SAGE tags. In addition their entire nucleotide sequences are known and publicly available. In general, these were not previously identified as genes due to their small size. However, they have now been found to be expressed.

Differentially expressed yeast genes are those whose expression varies by a statistically significant difference (to greater than 95% confidence level) within different growth phases, particularly log phase, S phase, and G2/M. Preferably the difference is at least 10%, 25%, 50%, or 100%. In some cases, differentially expressed genes are not expressed at detectable levels in one or more cell cycle phases as determined by SAGE analysis. Genes which have been found to have differential expression characteristics include: NORF № 1 (SEQ ID NO:12,220), 2 (SEQ ID NO:12,221), 4 (SEQ ID NO:12,222), 5 (SEQ ID NO: 12,223), 6 (SEQ ID NO:12,224), 17 (SEQ ID NO:12,225), 25 (SEQ ID NO:12,226), 27 (SEQ ID NO:12,227), TEF1/TEF2, EN02, ADH1, ADH2, PGK1, CUP1A/CUP1B, PYK1, YKL056C, YMR116C, YEL033W, YOR182C, YCR013C, ribonucleotide reductase 2 and 4, and YJR085C. Differential expression can be detected by any means known in the art, such as hybridization to specific probes or immunological assays.

Isolated DNA molecules according to the invention contain less than a whole chromosome and can be genomic or cDNA, i.e., lacking introns. Isolated DNA molecules can comprise a yeast gene or a coding sequence of a yeast gene involved in cell cycle progression, such as NORF genes which comprise SAGE tags as shown in SEQ ID NOS:67-811. Isolated DNA molecules which comprise yeast genes or coding sequences of yeast genes comprising SAGE tags as shown in SEQ ID NOS:37-12,203 are also isolated DNA molecules of the invention. Isolated DNA molecules can also consist of a yeast gene or a coding sequence of a yeast gene which comprises a SAGE tag as shown in SEQ ID NOS:37-12,203 or 67-811.

Any technique for obtaining a DNA of known sequence may be used to obtain isolated DNA molecules of the invention. Preferably they are isolated free of other cellular components such as membrane components, proteins, and lipids. They can be made by a cell and isolated, or synthesized using PCR or an automatic synthesizer. Methods for purifying and isolating DNA are routine and are known in the art.

To administer yeast genes to cells, any DNA delivery techniques known in the art may be used, without limitation. These include liposomes, transfection, mating, transduction, transformation, viral infection, electroporation. Vectors for particular purposes and characteristics can be selected by the skilled artisan for their known properties. Cells which can be used as gene recipients are yeast and other fungi, mammalian cells, including humans, and bacterial cells.

Antifungal drugs can be identified using yeast cells as described herein. Expression of a differentially expressed NORF gene can be monitored by any means known in the art. When a test substance modifies the expression of such a differentially expressed gene, for example by increasing or decreasing its expression, it is a candidate drug for affecting the growth properties of fungi and may be useful as an antifungal agent. Expression of more than one NORF gene can be monitored. For example, expression of 2, 3, 4, 5, 10, 15, 20, 30, 40, 50, 60, 75, 100, 150, 250, 300, 350, 400, 450, or 500 or more NORF genes can be monitored in single or multiple assays.

Because differentially expressed genes are likely to be involved in cell cycle progression, it is likely that these genes are conserved among species. The differentially expressed NORF genes identified by the present invention can be used to identify homologs in humans and other mammals by contacting DNA from these mammals with a probe which comprises at least 10 contiguous nucleotides of a differentially expressed NORF gene. The DNA can be genomic or cDNA, as is known in the art. Means for identifying homologous genes among different species are well known in the art. Briefly, stringency of hybridization can be reduced so that imperfectly matching sequences hybridize. This can be in the context of inter alia Southern blots, Northern blots, colony hybridization or PCR. Any hybridization technique which is known in the art can be used. A DNA sequence which hybridizes to the probe is identified as a sequence of a candidate gene which is involved in cell cycle expression.

Probes according to the present invention are isolated DNA molecules which have at least 10, and preferably at least 12, 14, 16, 18, 20, or 25 contiguous nucleotides of a particular NORF gene or other differentially expressed gene. The probes may or may not be labeled. They may be used, for example, as primers for PCR assays, or for detection of gene expression for Southern or Northern blots or in situ hybridization. Preferably the probes are immobilized on a solid support. The solid support can be any surface to which a probe can be attached. Suitable solid supports include, but are not limited to, glass or plastic slides, tissue culture plates, microtiter wells, tubes, or particles such as beads, including but not limited to latex, polystyrene, or glass beads. Any method known in the art can be used to attach the a probe to the solid support, including use of covalent and non-covalent linkages, passive absorption, or pairs of binding moieties attached respectively to the probe and the solid support.

More preferably, probes are present on an array so that multiple probes can simultaneously hybridize to a single biological sample. The probes can be spotted onto the array or synthesized in situ on the array. See Lockhart et. al., Nature Biotechnology, Vol. 14, December 1996, "Expression monitoring by hybridization to high-density oligonucleotide arrays." A single array contains at least one NORF probe, but can contain more than 100, 500 or even 1,000 different probes in discrete locations. If desired, one or more NORF probe(s) present on the array can be nucleotide sequences from a NORF gene which is differentially expressed during the cell cycle.

Genes identified by the present invention which are differentially expressed during the cell cycle can also be used to obtain gene expression profiles characteristic of the response of yeast genes of a yeast cell to a particular drug or class of drugs. Classes of drugs of particular interest for which gene expression profiles can be generated include those drugs which affect cell cycle or other cell processes, such as chemotherapeutic agents. If desired, gene expression profiles characteristic of more than one drug of a particular class can be generated and used to make a composite gene expression profile. For example, microtubule poison drugs such as vinblastin, taxol, vincristine, and taxotere can be used to generate gene expression profiles characteristic of microtubule poisons.

To generate a gene expression profile characteristic of a particular drug or class of drugs, a yeast cell is contacted with a particular drug or a member of a particular class of drugs. Expression of at least one yeast gene is monitored, either before and after contacting or in the contacted cell and in another yeast cell which has not been contacted with the drug. Genes which are monitored can be any yeast gene, including NORFS. Preferably, these genes are differentially expressed during the cell cycle. For example, yeast genes can be selected from genes comprising the SAGE tags shown in Tables 3, 4, 5, and 6 (SEQ ID NOS:67-12,203). If desired, genes such as NORF № 1, 2, 4, 5, 6, 17, 25, or 27, TEF1/TEF2, EN02, ADH1, ADH2, PGK1, CUP1A/CUP1B, PYK1, YKL056C, YMR116C, YEL033W, YOR182C, YCR013C, ribonucleotide reductase 2 and 4, and YJR085C, can be used for monitoring alterations in gene expression.

The expression of any number of these genes, such as 1, 2, 3, 4, 5, 10, 15, 20, 25, 30, 40, 50, 60, 75, 100, 150, 250, 500, 1000, 2000, 3000, 4000, 5000, or 5,500 genes, can be measured. It is particularly convenient to monitor expression of the differentially expressed genes using nucleic acids which are immobilized on a solid support or in an array, such as the gene arrays described above.

Many genes, particularly cell cycle genes, are likely to be conserved between yeast and mammals, including humans. Thus, gene expression profiles characteristic of a drug or class of drugs can be used to predict the effects of candidate drugs on human cells, by identifying the candidate drug as a member of a class of drugs whose characteristic gene expression profile is known. The candidate drugs can be pharmacologic agents already known in the art or can be compounds previously unknown to have any pharmacological activity. The candidate drugs can be naturally occurring or designed in the laboratory. They can be isolated from microorganisms, animals, or plants, and can be produced recombinantly or synthesized by chemical methods known in the art.

The effect of a candidate drug on expression of at least one gene whose expression is affected by the class of drugs is monitored. A gene expression profile obtained using the candidate drug which is similar to a gene expression profile for a particular drug or class of drugs identifies the candidate drug as a member of that class of drugs.

The effect of modifying particular substituents of a known drug or of a candidate drug can be similarly tested. Such methods are useful for determining whether alterations intended, for example, to increase solubility or absorption of a particular drug will have an unintended and possibly deleterious effect on genes which are differentially expressed during the cell cycle.

The above disclosure generally describes the present invention. A more complete understanding can be obtained by reference to the following specific examples which are provided herein for purposes of illustration only, and are not intended to limit the scope of the invention.

EXAMPLE

Summary

We have analyzed the set of genes expressed from the yeast genome, herein called the transcriptome, using serial analysis of gene expression (SAGE). Analysis of 60,633 transcripts revealed 4,665 genes, with expression levels ranging from 0.3 to over 200 transcripts per cell. Of these genes, 1,981 had known functions, while 2,684 were previously uncharacterized. Integration of positional information with gene expression data allowed the generation of chromosomal expression maps, identifying physical regions of transcriptional activity, and identified genes that had not been predicted by sequence information alone. These studies provide insight into global patterns of gene expression in yeast and demonstrate the feasibility of genome-wide expression studies in eukaryotes.

Results

Characteristics and Rationale of SAGE Approach

Several methods have recently been described for the high throughput evaluation of gene expression (Nguyen et al., 1995; Schena et al., 1995; Velculescu et al., 1995). We used SAGE (Serial Analysis of Gene Expression) because it can provide quantitative gene expression data without the prerequisite of a hybridization probe for each transcript. The SAGE technology is based on two basic principles (FIG. 1). First, a short sequence tag (9-11 bp) contains sufficient information to uniquely identify a transcript, provided that it is derived from a defined location within that transcript. Second, many transcript tags can be concatenated into a single molecule and then sequenced, revealing the identity of multiple tags simultaneously. The expression pattern of any population of transcripts can be quantitatively evaluated by determining the abundance of individual tags and identifying the gene corresponding to each tag.

Genome-Wide Expression

In order to maximize representation of genes involved in normal growth and cell-cycle progression, SAGE libraries were generated from yeast cells in three states: log phase, S phase arrested and G2/M phase arrested. In total, SAGE tags corresponding to 60,633 total transcripts were identified (including 20,184 from log phase, 20,034 from S phase arrested, and 20,415 from G2/M phase arrested cells). Of these tags, 56,291 tags (93%) precisely matched the yeast genome, 88 tags matched the mitochondrial genome, and 91 tags matched the 2 micron plasmid.

The number of SAGE tags required to define a yeast transcriptome depends on the confidence level desired for detecting low abundance mRNA molecules. Assuming the previously derived estimate of 15,000 mRNA molecules per cell (Hereford and Rosbash, 1977), 20,000 tags would represent a 1.3 fold coverage even for mRNA molecules present at a single copy per cell, and would provide a 72% probability of detecting such transcripts (as determined by Monte Carlo simulations). Analysis of 20,184 tags from log phase cells identified 3,298 unique genes. As an independent confirmation of mRNA copy number per cell, we compared the expression level of SUP44/RPS4, one of the few genes whose absolute mRNA levels have been reliably determined by quantitative hybridization experiments (Iyer and Struhl, 1996), with expression levels determined by SAGE. SUP44/RPS4 was measured by hybridization at 75+/−10 copies/cell (Iyer and Struhl, 1996), in good accord with the SAGE data of 63 copies/cell, suggesting that the estimate of 15,000 mRNA molecules per cell was reasonably accurate. Analysis of SAGE tags from S phase arrested and G2/M phase arrested cells revealed similar expression levels for this gene (range 52 to 55 copies/cell), as well as for the vast majority of expressed genes. As less than 1% of the genes were expressed at dramatically different levels among these three states (see below), SAGE tags obtained from all libraries were combined and used to analyze global patterns of gene expression.

Figure 2:
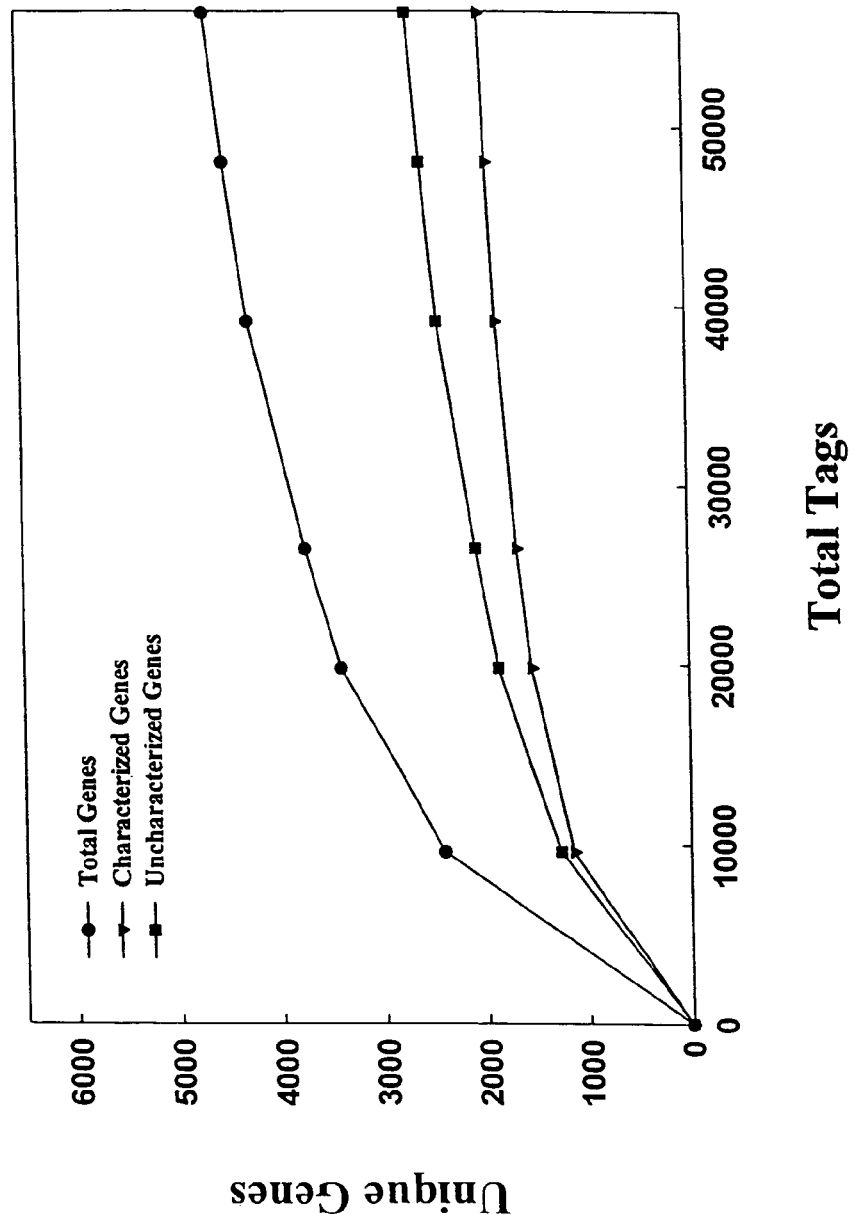
FIG. 2. Sampling of Yeast Gene Expression. Analysis of increasing amounts of ascertained tags reveals a plateau in the number of unique expressed genes. Triangles represent genes with known functions, squares represent genes predicted on the basis of sequence information, and circles represent total genes.

Analysis of ascertained tags at increasing increments revealed that the number of unique transcripts plateaued at ~60,000 tags (FIG. 2). This suggested that generation of further SAGE tags would yield few additional genes, consistent with the fact that sixty thousand transcripts represented a four-fold redundancy for genes expressed as low as 1 transcript per cell. Likewise, Monte Carlo simulations indicated that analysis of 60,000 tags would identify at least one tag for a given transcript 97% of the time if its expression level was one copy per cell.

The 56,291 tags that precisely matched the yeast genome represented 4,665 different genes. This number is in agreement with the estimate of 3,000 to 4,000 expressed genes obtained by RNA-DNA reassociation kinetics (Hereford and Rosbash, 1977). These expressed genes included 85% of the genes with characterized functions (1,981 of 2;340), and 76% of the total genes predicted from analysis of the yeast genome (4,665 of 6,121). These numbers are consistent with a relatively complete sampling of the yeast transcriptome given the limited number of physiological states examined and the large number of genes predicted solely on the basis of genomic sequence analysis.

Figure 3:
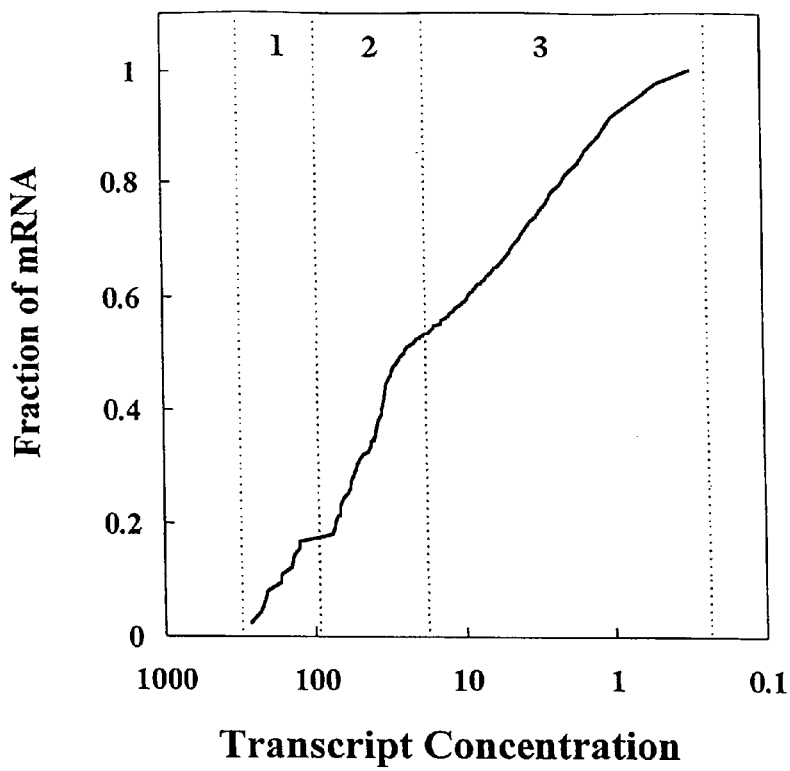
FIG. 3. Virtual Rot. (A) Abundance Classes in the Yeast Transcriptome. The transcript abundance is plotted in reverse order on the abscissa, whereas the fraction of total transcripts with at least that abundance is plotted on the ordinate. The dotted lines identify the three components of the curve, 1, 2, and 3. This is analogous to a Rot curve derived from reassociation kinetics where the product of initial RNA concentration and time is plotted on the abscissa, and the percent of labeled cDNA that hybridizes to excess mRNA is plotted on the ordinate. (B) Comparison of Virtual Rot and Rot Components. Transitions and data from virtual Rot components were calculated from the data in FIG. 3A, while data for Rot components were obtained from Hereford and Rosbash, 1977.

The transcript expression per gene was observed to vary from 0.3 to over 200 copies per cell. Analysis of the distribution of gene expression levels revealed several abundance classes that were similar to those observed in previous studies using reassociation kinetics. A "virtual Rot" of the genes observed by SAGE (FIG. 3A) identified three main components of the transcriptome with abundances ranging over three orders of magnitude. A Rot curve derived from RNA-cDNA reassociation kinetics also contained three main components distributed over a similar range of abundances (Hereford and Rosbash, 1977). Although the kinetics of reassociation of a particular class of RNA and cDNA may be affected by numerous experimental variables, there were striking similarities between Rot and virtual Rot analyses (FIG. 3B). Because Rot analysis may not detect all transcripts of low abundance (Lewin, 1980), it is not surprising that SAGE revealed both a larger total number of expressed genes and a higher fraction of the transcriptome belonging to the low abundance transcript class.

Integration of Expression Information with the Genomic Map

Figure 4:
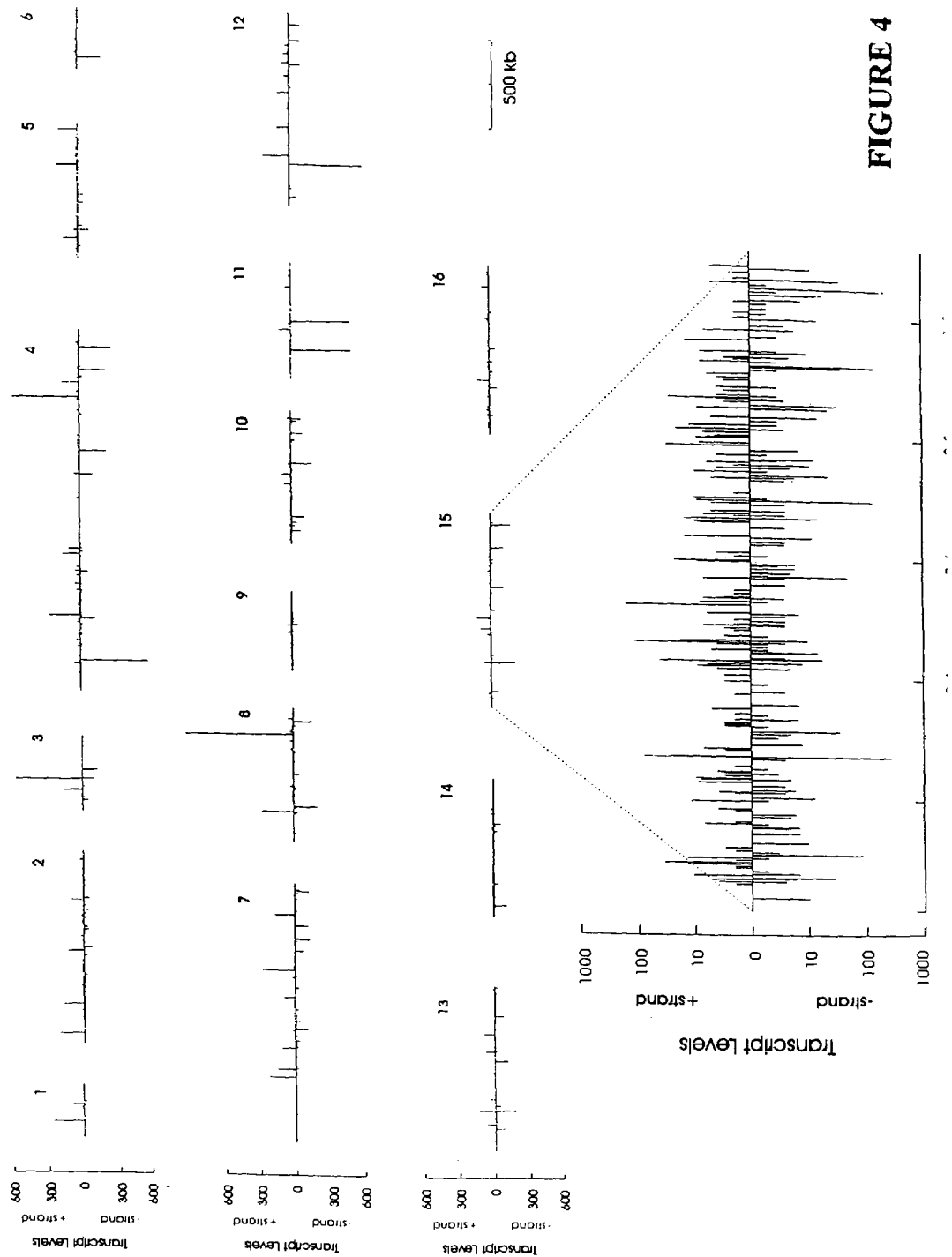
FIG. 4. Chromosomal Expression Map for S. cerevisiae. Individual yeast genes were positioned on each chromosome according to their open reading frame (ORF) start coordinates. Abundance levels of tags corresponding to each gene are displayed on the vertical axis, with transcription from the + strand indicated above the abscissa and that from the − strand indicated below. Yellow bands at ends of the expanded chromosome represent telomeric regions that are undertranscribed (see text for details).

The SAGE expression data could be integrated with existing positional information to generate chromosomal expression maps (FIG. 4). These maps were generated using the sequence of the yeast genome and the position coordinates of ORFs obtained from the Stanford Yeast Genome Database. Although there were a few genes that were noted to be physically proximal and have similarly high levels of expression, there did not appear to be any clusters of particularly high or low expression on any chromosome. Genes like histones H3 and H4, which are known to have coregulated divergent promoters and are immediately adjacent on chromosome 14 (Smith and Murray, 1983), had very similar expression levels (5 and 6 copies per cell, respectively). The distribution of transcripts among the chromosomes suggested that overall transcription was evenly dispersed, with total transcript levels being roughly linearly related to chromosome size ($r^2$=0.85, data not shown). However, regions within 10 kb of telomeres appeared to be uniformly undertranscribed, containing on average 3.2 tags per gene as compared with 12.4 tags per gene for non-telomeric regions (FIG. 4). This is consistent with the previously described observations of "telomeric silencing" in yeast (Gottschling et al., 1990). Recent studies have reported telomeric position effects as far as 4 kb from telomere ends (Renauld et al., 1993).

Gene Expression Patterns

Table 1 lists the 30 most highly expressed genes, all of which are expressed at greater than 60 mRNA copies per cell. As expected, these genes mostly correspond to well characterized enzymes involved in energy metabolism and protein synthesis and were expressed at similar levels in all three growth states (Examples in FIG. 5). Some of these genes, including ENO2 (McAlister and Holland, 1982), PDC1 (Schmitt et al., 1983), PGK1 (Chambers et al., 1989), PYK1 (Nishizawa et al., 1989), and ADH1 (Denis et al., 1983), are known to be dramatically induced in the glucose-rich growth conditions used in this study. In contrast, glucose repressible genes such as the GAL1/GAL7/GAL10 cluster (St John and Davis, 1979), and GAL3 (Bajwa et al., 1988) were observed to be expressed at very low levels (0.3 or fewer copies per cell).

As expected for the yeast strain used in this study, mating type a specific genes, such as the a factor genes (MFA1, MFA2) (Michaelis and Herskowitz, 1988), and alpha factor receptor (STE2) (Burkholder and Hartwell, 1985) were all observed to be expressed at significant levels (range 2 to 10 copies per cell), while mating type alpha specific genes (MFα1, MFα2, STE3) (Hagen et al., 1986; Kurjan and Herskowitz, 1982; Singh et al., 1983) were observed to be expressed at very low levels (<0.3 copies/cell).

Three of the highly expressed genes in Table 1 had not been previously characterized. One contained an ORF with predicted ribosomal function, previously identified only by genomic sequence analysis. Analyses of all SAGE data suggested that there were 2,684 such genes corresponding to uncharacterized ORFs which were transcribed at detectable levels. The 30 most abundant of these transcripts were observed more than 30 times, corresponding to at least 8 transcripts per cell (Table 2). The other two highly expressed uncharacterized genes corresponded to ORFs not predicted by analysis of the yeast genome sequence (NORF=Nonannotated ORF). Analyses of SAGE data suggested that there were at least 160 NORF genes transcribed at detectable levels. The 30 most abundant of these transcripts were observed at least 9 times (Table 3 and examples in FIG. 5).

Interestingly, one of the NORF genes (NORF5) was only expressed in S phase arrested cells and corresponded to the transcript whose abundance varied the most in the three states analyzed (>49 fold, FIG. 5). Comparison of S phase arrested cells to the other states also identified greater than 9 fold elevation of the RNR2 and RNR4 transcripts (FIG. 5). Induction of these ribonucleoside reductase genes is likely to be due to the hydroxyurea treatment used to arrest cells in S phase (Elledge and Davis, 1989). Likewise, comparison of G2/M arrested cells identified elevation of RBL2 and dynein light chain, both microtubule associated proteins (Archer et al., 1995; Dick et al., 1996). As with the RNR inductions, these elevated levels seem likely to be related to the nocodazole treatment used to arrest cells in the G2/M phase. While there were many relatively small differences between the states (for example, NORF1, FIG. 5), overall comparison of the three states revealed surprisingly few dramatic differences; there were only 29 transcripts whose abundance varied more than 10 fold among the three different states analyzed (Tables 4 and 5).

A comprehensive analysis for NORF genes was performed using the SAGE data. Yeast genome intergenic regions were defined as regions outside annotated ORFs or the 500 bp region downstream of annotated ORFs (yeast genome sequence and tables of annotated ORFs were obtained from SGD at the Stanford *Saccharomyces* genome website). Based on sequence analysis a total of 9524 putative ORFs of 25-99 amino acids were present in the intergenic regions; 510 of these ORFs contain or are adjacent to observed SAGE tags (Table 6). Of the 60,633 SAGE tags analyzed, there were 302 unique SAGE tags either within or adjacent to intergenic ORFs (100 bp upstream or 500 bp downstream of the ORF) (Table 6). Note that in some cases, more than one NORF contains or is adjacent to the SAGE tag. These tags matched the genome uniquely, were in the correct orientation, and were expressed at levels greater than 0.3 transcript copies per cell.

The expression level for each NORF shown in Table 6 corresponds to the number of mRNA transcript copies per cell. If the expression level is positive it means that the tag is on the + strand of the chromosome; if negative, the tag is on the − strand of the chromosome.

Discussion

Analysis of a yeast transcriptome affords a unique view of the RNA components defining cellular life. Comparison of gene expression patterns from altered physiologic states can provide insight into genes that are important in a variety of processes. Comparison of transcriptomes from a variety of physiologic states should provide a minimum set of genes whose expression is required for normal vegetative growth, and another set composed of genes that will be expressed only in response to specific environmental stimuli, or during specialized processes. For example, recent work has defined a minimal set of 250 genes required for prokaryotic cellular life (Mushegian and Koonin, 1996). Examination of the yeast genome readily identified homologous genes for 196 of these, over 90% of which were observed to be expressed in the SAGE analysis. Detailed analyses of yeast transcriptomes, as well as transcriptomes from other organisms, should ultimately allow the generation of a minimal set of genes required for eukaryotic life.

Like other genome-wide analyses, SAGE analysis of yeast transcriptomes has several potential limitations. First, a small number of transcripts would be expected to lack an NlaIII site and therefore would not be detected by our analysis. Second, our analysis was limited to transcripts found at least as frequently as 0.3 copies per cell. Transcripts expressed in only a minute fraction of the cell cycle, or transcripts expressed in only a fraction of the cell population, would not be reliably detected by our analysis. Finally, mRNA sequence data are practically unavailable for yeast, and consequently, some SAGE tags cannot be unambiguously matched to corresponding genes. Tags which were derived from overlapping genes, or genes which have unusually long 3' untranslated regions may be misassigned. Increased availability of 3' UTR sequences in yeast mRNA molecules should help to resolve the ambiguities.

Despite these potential limitations, it is clear that the analyses described here furnish both global and local pictures of gene expression, precisely defined at the nucleotide level. These data, like the sequence of the yeast genome itself, provide simple, basic information integral to the interpretation of many experiments in the future. The availability of mRNA sequence information from EST sequencing as well as various genome projects, will soon allow definition of transcriptomes from a variety of organisms, including human. The data recorded here suggest that a reasonably complete picture of a human cell transcriptome will require only about 10-20 fold more tags than evaluated here, a number well within the practical realm achievable with a small number of automated sequencers. The analysis of global expression patterns in higher eukaryotes is expected, in general, to be similar to those reported here for S. cerevisiae. However, the analysis of the transcriptome in different cells and from different individuals should yield a wealth of information regarding gene function in normal, developmental, and disease states.

Experimental Procedures

Yeast Cell Culture

The source of transcripts for all experiments was S. cerevisiae strain YPH499 (MATa ura3-52 lys2-801 ade2-101 leu2-Δ1 his3-Δ200 trp1-Δ63) (Sikorski and Hieter, 1989). Logarithmically growing cells were obtained by growing yeast cells to early log phase ($3 \times 10^6$ cells/ml) in YPD (Rose et al., 1990) rich medium (YPD supplemented with 6 mM uracil, 4.8 mM adenine and 24 mM tryptophan) at 30° C. For arrest in the G1/S phase of the cell cycle, hydroxyurea (0.1 M) was added to early log phase cells, and the culture was incubated an additional 3.5 hours at 30° C. For arrest in the G2/M phase of the cell cycle, nocodazole (15 μg/ml) was added to early log phase cells and the culture was incubated for an additional 100 minutes at 30° C. Harvested cells were washed once with water prior to freezing at −70° C. The growth states of the harvested cells were confirmed by microscopic and flow cytometric analyses (Basrai et al., 1996).

SAGE Protocol

The SAGE method was performed as previously described (Velculescu et al., 1995; Kinzler et al., U.S. Pat. Nos. 5,866,330 and 5,695,937), with exceptions noted below. PolyA RNA was converted to double-stranded cDNA with a BRL synthesis kit using the manufacturer's protocol except for the inclusion of primer biotin-5'-$T_{18}$-3'. The cDNA was cleaved with NlaIII (Anchoring Enzyme). As NlaIII sites were observed to occur once every 309 base pairs in three arbitrarily chosen yeast chromosomes (1, 5, 10), 95% of yeast transcripts were predicted to be detectable with a NlaIII-based SAGE approach. After capture of the 3' cDNA fragments on streptavidin coated magnetic beads (Dynal), the bound cDNA was divided into two pools, and one of the following linkers containing recognition sites for BsmFI was ligated to each pool: Linker 1,5'-TTTGGATTTGCTGGTG-CAGTACAACTAGGCTTAATAGGGACATG-3' (SEQ ID NO:1).5'-TCCCTATTAAGCCTAGTTGTACTGCAC-CAGCAAATCC [amino mod. C7]-3'(SEQ ID NO:2); Linker 2,5'-TTTCTGCTCGAATTCAAGCTTCTAAC-GATGTACGGGGACATG-3' (SEQ ID NO:3), 5'-TCCCCG-TACATCGTTAGAAGCTTGAATTCGAGCAG[amino mod. C7]-3' (SEQ ID NO:4).

As BsmFI (Tagging Enzyme) cleaves 14 bp away from its recognition site, and the NlaIII site overlaps the BsmFI site by 1 bp, a 15 bp SAGE tag was released with BsmFI. SAGE tag overhangs were filled-in with Klenow, and tags from the two pools were combined and ligated to each other. The ligation product was diluted and then amplified with PCR for 28 cycles with 5'-GGATTTGCTGGTGCAGTACA-3' (SEQ ID NO:5) and 5'-CTGCTCGAATTCAAGCTTCT-3' (SEQ ID NO:6), as primers. The PCR product was analyzed by polyacrylamide gel electrophoresis (PAGE), and the PCR product containing two tags ligated tail to tail (ditag) was excised. The PCR product was then cleaved with NlaIII, and the band containing the ditags was excised and self-ligated. After ligation, the concatenated products were separated by PAGE and products between 500 bp and 2 kb were excised. These products were cloned into the SphI site of pZero (Invitrogen). Colonies were screened for inserts by PCR with M13 forward and M13 reverse sequences located outside the cloning site as primers.

PCR products from selected clones were sequenced with the TaqFS DyePrimer kits (Perkin Elmer) and analyzed using a 377 ABI automated sequencer (Perkin Elmer), following the manufacturer's protocol. Each successful sequencing reaction identified an average of 26 tags; given a 90% sequencing reaction success rate, this corresponded to an average of about 850 tags per sequencing gel.

SAGE Data Analysis

Sequence files were analyzed by means of the SAGE program group (Velculescu et al., 1995), which identifies the anchoring enzyme site with the proper spacing and extracts the two intervening tags and records them in a database. The 68,691 tags obtained contained 62,965 tags from unique ditags and 5,726 tags from repeated ditags. The latter were counted only once to eliminate potential PCR bias of the quantitation, as described (Velculescu et al., 1995). Of 62,965 tags, 2,332 tags corresponded to linker sequences, and were excluded from further analysis. Of the remaining tags, 4,342 tags could not be assigned, and were likely due to sequencing errors (in the tags or in the yeast genomic sequence). If all of these were due to tag sequencing errors, this corresponds to a sequencing error rate of about 0.7% per base pair (for a 10 bp tag), not far from what we would have expected under our automated sequencing conditions. However, some unassigned tags had a much higher than expected frequency of A's as the last five base pairs of the tag (5 of the 52 most abundant unassigned tags), suggesting that these tags were derived from transcripts containing anchoring enzyme sites within several base pairs from their polyA tails. Given the frequency of NlaIII sites in the genome (one in 309 base pairs), approximately 3% of transcripts were predicted to contain NlaIII sites within 10 bp of their polyA tails.

As very sparse data are available for yeast mRNA sequences and efforts to date have not been able to identify a highly conserved polyadenylation signal (Irniger and Braus, 1994; Zaret and Sherman, 1982), we used 14 bp of SAGE tags (i.e. the NlaIII site plus the adjacent 10 bp) to search the yeast genome directly (yeast genome sequence obtained from the Stanford yeast genome ftp site [(genome-ftp.stanford.edu)] on Aug. 7, 1996, SEQ ID NOS:812-827). Because only coding regions are annotated in the yeast genome, and SAGE tags can be derived from 3' untranslated regions of genes, a SAGE tag was considered to correspond to a particular gene if it matched the ORF or the region 500 bp 3' of the ORF (locus names, gene names and ORF chromosomal coordinates were obtained from Stanford yeast genome ftp site, and ORF descriptions were obtained from MIPS www site on Aug. 14, 1996). ORFs were considered genes with known functions if they were associated with a three letter gene name, while ORFs without such designations were considered uncharacterized.

As expected, SAGE tags matched transcribed portions of the genome in a highly non-random fashion, with 88% matching ORFs or their adjacent 3' regions in the correct orientation (chi-squared P value $<10^{-30}$. In instances when more than one tag matched a particular ORF in the correct orientation, the abundance was calculated to be the sum of the matched tags. Tags that matched ORFs in the incorrect orientation were not used in abundance calculations. In instances when a tag matched more than one region of the genome (for example an ORF and non-ORF region) only the matched ORF was considered. In some cases the 15th base of the tag could also be used to resolve ambiguities.

For the identification of NORF genes, only tags were considered that matched portions of the genome that were further than 500 bp 3' of a previously identified ORF and were observed at least two times in the SAGE libraries.

Lengthy table referenced here

US07504493-20090317-T00001

Please refer to the end of the specification for access instructions.

Lengthy table referenced here

US07504493-20090317-T00002

Please refer to the end of the specification for access instructions.

Lengthy table referenced here

US07504493-20090317-T00003

Please refer to the end of the specification for access instructions.

Lengthy table referenced here

US07504493-20090317-T00004

Please refer to the end of the specification for access instructions.

Lengthy table referenced here

US07504493-20090317-T00005

Please refer to the end of the specification for access instructions.

Lengthy table referenced here

US07504493-20090317-T00006

Please refer to the end of the specification for access instructions.

REFERENCES

Archer, J. E., Vega, L. R., and Solomon, F. (1995). Rbl2p, a yeast protein that binds to beta-tubulin and participates in microtubule function in vivo. Cell 82, 425-434.

Bajwa, W., Torchia, T. E., and Hopper, J. E. (1988). Yeast regulatory gene GAL3: carbon regulation; UASGal elements in common with GAL1, GAL2, GAL7, GAL10, GAL80, and MEL1; encoded protein strikingly similar to yeast and *Escherichia coli* galactokinases. Mol Cell Biol 8, 3439-3447.

Basrai, M. A., Kingsbury, J., Koshland, D., Spencer, F., and Hieter, P. (1996). Faithful chromosome transmission requires Spt4p, a putative regulator of chromatin structure in *Saccharomyces cerevisiae*. Mol Cell Biol 16, 2838-2847.

Bishop, J. O., Morton, J. G., Rosbash, M., and Richardson, M. (1974). Three abundance classes in HeLa cell messenger RNA. Nature 250, 199-204.

Burkholder, A. C., and Hartwell, L. H. (1985). The yeast alpha-factor receptor: structural properties deduced from the sequence of the STE2 gene. Nucleic Acids Res 13, 8463-8475.

Chambers, A., Tsang, J. S., Stanway, C., Kingsman, A. J., and Kingsman, S. M. (1989). Transcriptional control of the *Saccharomyces cerevisiae* PGK gene by RAP1. Mol Cell Biol 9, 5516-5524.

Denis, C. L., Ferguson, J., and Young, E. T. (1983). mRNA levels for the fermentative alcohol dehydrogenase of *Saccharomyces cerevisiae* decrease upon growth on a nonfermentable carbon source. J Biol Chem 258, 1165-1171.

Dick, T., Surana, U., and Chia, W. (1996). Molecular and genetic characterization of SLC1, a putative *Saccharomyces cerevisiae* homolog of the metazoan cytoplasmic dynein light chain1. Mol Gen Genet 251, 38-43.

El-Deiry, W. S., Tokino, T., Velculescu, V. E., Levy, D. B., Parsons, R., Trent, J. M., Lin, D., Mercer, W. E., Kinzler, K. W., and Vogelstein, B. (1993). WAF1, a potential mediator of p53 tumor suppression. Cell 75, 817-825.

Elledge, S. J., and Davis, R. W. (1989). DNA damage induction of ribonucleotide reductase. Mol Cell Biol 9, 4932-4940.

Goffeau, A., Barrell, B. G., Bussey, H., Davis, R. W., Dujon, B., Feldmann, H., Galibert, F., Hoheisel, J. D., Jacq, C., Johnston, M., Louis, E. J., Mewes, H. W., Murakami, Y., Philippsen, P., Tettelin, H., and Oliver, S. G. (1996). Life with 6000 genes. Science 274, 546-567.

Gottschling, D. E., Aparicio, O. M., Billington, B. L., and Zakian, V. A. (1990). Position effect at *S. cerevisiae* telomeres: reversible repression of Pol II transcription. Cell 63, 751-762.

Hagen, D. C., McCaffrey, G., and Sprague, G. F., Jr. (1986). Evidence the yeast STE3 gene encodes a receptor for the peptide pheromone a factor: gene sequence and implications for the structure of the presumed receptor. Proc Natl Acad Sci USA 83, 1418-1422.

Hereford, L. M., and Rosbash, M. (1977). Number and distribution of polyadenylated RNA sequences in yeast. Cell 10, 453-462.

Irniger, S., and Braus, G. H. (1994). Saturation mutagenesis of a polyadenylation signal reveals a hexanucleotide element essential for mRNA 3' end formation in *Saccharomyces cerevisiae*. Proc Natl Acad Sci USA 91, 257-261.

Iyer, V., and Struhl, K. (1996). Absolute mRNA levels and transcriptional initiation rates in *Saccharomyces cerevisiae*. Proc Natl Acad Sci USA 93, 5208-5212.

Kurjan, J., and Herskowitz, I. (1982). Structure of a yeast pheromone gene (MF alpha): a putative alpha-factor precursor contains four tandem copies of mature alpha-factor. Cell 30, 933-943.

Leeds, P., Peltz, S. W., Jacobson, A., and Culbertson, M. R. (1991). The product of the yeast UPF1 gene is required for rapid turnover of mRNAs containing a premature translational termination codon. Genes Dev 5, 230 3-2314.

Lewin, B. (1980). Gene Expression 2, (New York, N.Y.: John Wiley and Sons), pp. 694-727.

McAlister, L., and Holland, M. J. (1982). Targeted deletion of a yeast enolase structural gene. Identification and isolation of yeast enolase isozymes. J Biol Chem 257, 7181-7188.

Michaelis, S., and Herskowitz, I. (1988). The a-factor pheromone of *Saccharomyces cerevisiae* is essential for mating. Mol Cell Biol 8, 1309-1318.

Mushegian, A. R., and Koonin, E. V. (1996). A minimal gene set for cellular life derived by comparison of complete bacterial genomes. Proc. Natl. Acad. Sci. USA 93, 10268-10273.

Nguyen, C., Rocha, D., Granjeaud, S., Baldit, M., Bernard, K., Naquet, P., and Jordan, B. R. (1995). Differential gene expression in the murine thymus assayed by quantitative hybridization of arrayed cDNA clones. Genomics 29, 207-216.

Nishizawa, M., Araki, R., and Teranishi, Y. (1989). Identification of an upstream activating sequence and an upstream repressible sequence of the pyruvate kinase gene of the yeast *Saccharomyces cerevisiae*. Mol Cell Biol 9, 442-451.

Renauld, H., Aparicio, O. M., Zierath, P. D., Billington, B. L., Chhablani, S. K., and Gottschling, D. E. (1993). Silent domains are assembled continuously from the telomere and are defined by promoter distance and strength, and by SIR3 dosage. Genes Dev 7, 1133-1145.

Rose, M. D., Winston, F., and P. Hieter. (1990). Methods in Yeast Genetics. (Cold Spring Harbor, N.Y.: Cold Spring Harbor Laboratory Press), pp. 177.

Schena, M., Shalon, D., Davis, R. W., and Brown, P. O. (1995). Quantitative monitoring of gene expression patterns with a complementary DNA microarray. Science 270, 467-470.

Schmitt, H. D., Ciriacy, M., and Zimmermann, F. K. (1983). The synthesis of yeast pyruvate decarboxylase is regulated by large variations in the messenger RNA level. Mol Gen Genet 192, 247-252.

Sikorski, R. S., and Hieter, P. (1989). A system of shuttle vectors and yeast host strains designed for efficient manipulation of DNA in *Saccharomyces cerevisiae*. Genetics 122, 19-27.

Singh, A., Chen, E. Y., Lugovoy, J. M., Chang, C. N., Hitzeman, R. A., and Seeburg, P. H. (1983). *Saccharomyces cerevisiae* contains two discrete genes coding for the alpha-factor pheromone. Nucleic Acids Res 11, 4049-4063.

Smith, M. M., and Murray, K. (1983). Yeast H3 and H4 histone messenger RNAs are transcribed from two non-allelic gene sets. J Mol Biol 169, 641-661.

St John, T. P., and Davis, R. W. (1979). Isolation of galactose-inducible DNA sequences from *Saccharomyces cerevisiae* by differential plaque filter hybridization. Cell 16, 443-452.

Velculescu, V. E., Zhang, L., Vogelstein, B., and Kinzler, K. W. (1995). Serial analysis of gene expression. Science 270, 484-487.

Zaret, K. S., and Sherman, F. (1982). DNA sequence required for efficient transcription termination in yeast. Cell 28, 563-573.

LENGTHY TABLES

The patent contains a lengthy table section. A copy of the table is available in electronic form from the USPTO web site (http://seqdata.uspto.gov/?pageRequest=docDetail&DocID=US07504493B2). An electronic copy of the table will also be available from the USPTO upon request and payment of the fee set forth in 37 CFR 1.19(b)(3).

SEQUENCE LISTING (12227 sequences)

SEQ ID NO: 1 - DNA, 44 bp, Saccharomyces cerevisiae
tttggatttgctggtgcagtacaactaggcttaatagggacatg

SEQ ID NO: 2 - DNA, 37 bp, Saccharomyces cerevisiae
tccctattaagcctagttgtactgcaccagcaaatcc

SEQ ID NO: 3 - DNA, 42 bp, Saccharomyces cerevisiae
tttctgctcgaattcaagcttctaacgatgtacggggacatg

SEQ ID NO: 4 - DNA, 35 bp, Saccharomyces cerevisiae
tccccgtacatcgttagaagcttgaattcgagcag

SEQ ID NO: 5 - DNA, 20 bp, Saccharomyces cerevisiae
ggatttgctggtgcagtaca

SEQ ID NO: 6 - DNA, 20 bp, Saccharomyces cerevisiae
ctgctcgaattcaagcttct

SEQ ID NO: 7 - DNA, 10 bp, Saccharomyces cerevisiae
ggtgttaacg

SEQ ID NO: 8 - DNA, 10 bp, Saccharomyces cerevisiae
agacaaactg

SEQ ID NO: 9 - DNA, 10 bp, Saccharomyces cerevisiae
taccactcct

SEQ ID NO: 10 - DNA, 10 bp, Saccharomyces cerevisiae
ggtttcggtt

SEQ ID NO: 11 - DNA, 10 bp, Saccharomyces cerevisiae
ttgccagtct

SEQ ID NO: 12 - DNA, 10 bp, Saccharomyces cerevisiae
ggtgaaaacg

SEQ ID NO: 13 - DNA, 10 bp, Saccharomyces cerevisiae
atcgccgctc

SEQ ID NO: 14 - DNA, 10 bp, Saccharomyces cerevisiae
ggtgctaaga

SEQ ID NO: 15 - DNA, 10 bp, Saccharomyces cerevisiae
ttagtttcta

SEQ ID NO: 16 - DNA, 10 bp, Saccharomyces cerevisiae
tctctactgg

SEQ ID NO: 17 - DNA, 10 bp, Saccharomyces cerevisiae
ggttttggtt

SEQ ID NO: 18 - DNA, 10 bp, Saccharomyces cerevisiae
ggtccagctt

SEQ ID NO: 19 - DNA, 10 bp, Saccharomyces cerevisiae
aatccagttg

SEQ ID NO: 20 - DNA, 10 bp, Saccharomyces cerevisiae
ttcgttcact

SEQ ID NO: 21 - DNA, 10 bp, Saccharomyces cerevisiae
aacagaccag

SEQ ID NO: 22 - DNA, 10 bp, Saccharomyces cerevisiae
ctgctctggg

SEQ ID NO: 23 - DNA, 10 bp, Saccharomyces cerevisiae
gcaatactac

SEQ ID NO: 24 - DNA, 10 bp, Saccharomyces cerevisiae
gctctccccc

SEQ ID NO: 25 - DNA, 10 bp, Saccharomyces cerevisiae
aaagacagag

SEQ ID NO: 26 - DNA, 10 bp, Saccharomyces cerevisiae
tgtcgtggtg

SEQ ID NO: 27 - DNA, 10 bp, Saccharomyces cerevisiae
ccaagggtat

SEQ ID NO: 28 - DNA, 10 bp, Saccharomyces cerevisiae
tctccagaag

SEQ ID NO: 29 - DNA, 10 bp, Saccharomyces cerevisiae
gtttttcttt

SEQ ID NO: 30 - DNA, 10 bp, Saccharomyces cerevisiae
atcactggtg

SEQ ID NO: 31 - DNA, 10 bp, Saccharomyces cerevisiae
atgaaggttc

SEQ ID NO: 32 - DNA, 10 bp, Saccharomyces cerevisiae
gtagagccgg

SEQ ID NO: 33 - DNA, 10 bp, Saccharomyces cerevisiae
ggtactgatg

SEQ ID NO: 34 - DNA, 10 bp, Saccharomyces cerevisiae
ccagatttgt

SEQ ID NO: 35 - DNA, 10 bp, Saccharomyces cerevisiae
gtgccgtcca

SEQ ID NO: 36 - DNA, 10 bp, Saccharomyces cerevisiae
caaaacccaa

SEQ ID NO: 37 - DNA, 10 bp, Saccharomyces cerevisiae
ttgaactacc

SEQ ID NO: 38 - DNA, 10 bp, Saccharomyces cerevisiae
ttcgggtcac

SEQ ID NO: 39 - DNA, 10 bp, Saccharomyces cerevisiae
ccagatatga

SEQ ID NO: 40 - DNA, 10 bp, Saccharomyces cerevisiae
tttaaaatgg

SEQ ID NO: 41 - DNA, 10 bp, Saccharomyces cerevisiae
ggtgtcgttg

SEQ ID NO: 42 - DNA, 10 bp, Saccharomyces cerevisiae
tactcttcgc

SEQ ID NO: 43 - DNA, 10 bp, Saccharomyces cerevisiae
tgtaattaaa

SEQ ID NO: 44 - DNA, 10 bp, Saccharomyces cerevisiae
ggagatcttg

SEQ ID NO: 45 - DNA, 10 bp, Saccharomyces cerevisiae
tcaagaagtt

SEQ ID NO: 46 - DNA, 10 bp, Saccharomyces cerevisiae
aaaaactttg

SEQ ID NO: 47 - DNA, 10 bp, Saccharomyces cerevisiae
aagttgaaca

SEQ ID NO: 48 - DNA, 10 bp, Saccharomyces cerevisiae
gggtgcgggt

SEQ ID NO: 49 - DNA, 10 bp, Saccharomyces cerevisiae
tgactctttg

SEQ ID NO: 50 - DNA, 10 bp, Saccharomyces cerevisiae
ggtcaatggc

SEQ ID NO: 51 - DNA, 10 bp, Saccharomyces cerevisiae
taagaattct

SEQ ID NO: 52 - DNA, 10 bp, Saccharomyces cerevisiae
tcaattatgt

SEQ ID NO: 53 - DNA, 10 bp, Saccharomyces cerevisiae
acggccaaga

SEQ ID NO: 54 - DNA, 10 bp, Saccharomyces cerevisiae
ttgggctagt

SEQ ID NO: 55 - DNA, 10 bp, Saccharomyces cerevisiae
ccttccaggt

SEQ ID NO: 56 - DNA, 10 bp, Saccharomyces cerevisiae
cctctcttgt

SEQ ID NO: 57 - DNA, 10 bp, Saccharomyces cerevisiae
cccaaaactt

SEQ ID NO: 58 - DNA, 10 bp, Saccharomyces cerevisiae
aacaagtact

SEQ ID NO: 59 - DNA, 10 bp, Saccharomyces cerevisiae
aacaataaaa

SEQ ID NO: 60 - DNA, 10 bp, Saccharomyces cerevisiae
caaaagaccg

SEQ ID NO: 61 - DNA, 10 bp, Saccharomyces cerevisiae
ggtttttgat

SEQ ID NO: 62 - DNA, 10 bp, Saccharomyces cerevisiae
caatccattt

SEQ ID NO: 63 - DNA, 10 bp, Saccharomyces cerevisiae
ttttgggtct

SEQ ID NO: 64 - DNA, 10 bp, Saccharomyces cerevisiae
aactgtccat

SEQ ID NO: 65 - DNA, 10 bp, Saccharomyces cerevisiae
ccaaggttaa

SEQ ID NO: 66 - DNA, 10 bp, Saccharomyces cerevisiae
ggtttttgaa

SEQ ID NO: 67 - DNA, 10 bp, Saccharomyces cerevisiae
ttcgttcact

SEQ ID NO: 68 - DNA, 10 bp, Saccharomyces cerevisiae
gctctccccc

SEQ ID NO: 69 - DNA, 10 bp, Saccharomyces cerevisiae
tgtacgcatt

SEQ ID NO: 70 - DNA, 10 bp, Saccharomyces cerevisiae
ttttattatc

SEQ ID NO: 71 - DNA, 10 bp, Saccharomyces cerevisiae
cttctctttt

SEQ ID NO: 72 - DNA, 10 bp, Saccharomyces cerevisiae
tttcctataa

SEQ ID NO: 73 - DNA, 10 bp, Saccharomyces cerevisiae
tctagtcgcc

SEQ ID NO: 74 - DNA, 10 bp, Saccharomyces cerevisiae
atcgttttat

SEQ ID NO: 75 - DNA, 10 bp, Saccharomyces cerevisiae
ggccaatggt

SEQ ID NO: 76 - DNA, 10 bp, Saccharomyces cerevisiae
accctgtcat

SEQ ID NO: 77 - DNA, 10 bp, Saccharomyces cerevisiae
aaaagatcat

SEQ ID NO: 78 - DNA, 10 bp, Saccharomyces cerevisiae
cagaaaatgg

SEQ ID NO: 79 - DNA, 10 bp, Saccharomyces cerevisiae
tgacattctt

SEQ ID NO: 80 - DNA, 10 bp, Saccharomyces cerevisiae
tagacatcta

SEQ ID NO: 81 - DNA, 10 bp, Saccharomyces cerevisiae
tgccctggcc

SEQ ID NO: 82 - DNA, 10 bp, Saccharomyces cerevisiae
ggttttggcg

SEQ ID NO: 83 - DNA, 10 bp, Saccharomyces cerevisiae
ccatacaggt

SEQ ID NO: 84 - DNA, 10 bp, Saccharomyces cerevisiae
ccaaatcaaa

SEQ ID NO: 85 - DNA, 10 bp, Saccharomyces cerevisiae
aagcggtact

SEQ ID NO: 86 - DNA, 10 bp, Saccharomyces cerevisiae
aacgcttttc

SEQ ID NO: 87 - DNA, 10 bp, Saccharomyces cerevisiae
gaggatagag

SEQ ID NO: 88 - DNA, 10 bp, Saccharomyces cerevisiae
caatgaaccg

SEQ ID NO: 89 - DNA, 10 bp, Saccharomyces cerevisiae
tctttatata

SEQ ID NO: 90 - DNA, 10 bp, Saccharomyces cerevisiae
cgcctccagt

SEQ ID NO: 91 - DNA, 10 bp, Saccharomyces cerevisiae
tacgtaagtt

SEQ ID NO: 92 - DNA, 10 bp, Saccharomyces cerevisiae
gatttaaact

SEQ ID NO: 93 - DNA, 10 bp, Saccharomyces cerevisiae
gcgcctccaa

SEQ ID NO: 94 - DNA, 10 bp, Saccharomyces cerevisiae
caatggccca

SEQ ID NO: 95 - DNA, 10 bp, Saccharomyces cerevisiae
ttgaggaacg

SEQ ID NO: 96 - DNA, 10 bp, Saccharomyces cerevisiae
gctaagaacc

SEQ ID NO: 97 - DNA, 10 bp, Saccharomyces cerevisiae
ggcgcaattt

SEQ ID NO: 98 - DNA, 10 bp, Saccharomyces cerevisiae
taagtgatga

SEQ ID NO: 99 - DNA, 10 bp, Saccharomyces cerevisiae
ttgttgaatt

SEQ ID NO: 100 - DNA, 10 bp, Saccharomyces cerevisiae
gaagcagtaa

SEQ ID NO: 101 - DNA, 10 bp, Saccharomyces cerevisiae
acatatgtta

SEQ ID NO: 102 - DNA, 10 bp, Saccharomyces cerevisiae
ccctacacgg

SEQ ID NO: 103 - DNA, 10 bp, Saccharomyces cerevisiae
gtaattggac

SEQ ID NO: 104 - DNA, 10 bp, Saccharomyces cerevisiae
atcagacaaa

SEQ ID NO: 105 - DNA, 10 bp, Saccharomyces cerevisiae
ttatgaaaga

SEQ ID NO: 106 - DNA, 10 bp, Saccharomyces cerevisiae
attcgttcta

SEQ ID NO: 107 - DNA, 10 bp, Saccharomyces cerevisiae
agcaggagtt

SEQ ID NO: 108 - DNA, 10 bp, Saccharomyces cerevisiae
ttctattagg

SEQ ID NO: 109 - DNA, 10 bp, Saccharomyces cerevisiae
tggatttcag

SEQ ID NO: 110 - DNA, 10 bp, Saccharomyces cerevisiae
cagatataat

SEQ ID NO: 111 - DNA, 10 bp, Saccharomyces cerevisiae
ctgttttggg

SEQ ID NO: 112 - DNA, 10 bp, Saccharomyces cerevisiae
catttttagt

SEQ ID NO: 113 - DNA, 10 bp, Saccharomyces cerevisiae
ttgaaaagat

SEQ ID NO: 114 - DNA, 10 bp, Saccharomyces cerevisiae
taagcccatc

SEQ ID NO: 115 - DNA, 10 bp, Saccharomyces cerevisiae
agcgtcctca

SEQ ID NO: 116 - DNA, 10 bp, Saccharomyces cerevisiae
tttagttaat

SEQ ID NO: 117 - DNA, 10 bp, Saccharomyces cerevisiae
atggtagcca

SEQ ID NO: 118 - DNA, 10 bp, Saccharomyces cerevisiae
aattagacta

SEQ ID NO: 119 - DNA, 10 bp, Saccharomyces cerevisiae
agtgactctt

SEQ ID NO: 120 - DNA, 10 bp, Saccharomyces cerevisiae
ggactataag

SEQ ID NO: 121 - DNA, 10 bp, Saccharomyces cerevisiae
actttttcag

SEQ ID NO: 122 - DNA, 10 bp, Saccharomyces cerevisiae
gtcatatagt

SEQ ID NO: 123 - DNA, 10 bp, Saccharomyces cerevisiae
caacaaagtg

SEQ ID NO: 124 - DNA, 10 bp, Saccharomyces cerevisiae
gtgggaaagg

SEQ ID NO: 125 - DNA, 10 bp, Saccharomyces cerevisiae
tactttatat

SEQ ID NO: 126 - DNA, 10 bp, Saccharomyces cerevisiae
aataccagcg

SEQ ID NO: 127 - DNA, 10 bp, Saccharomyces cerevisiae
gccttgtata

SEQ ID NO: 128 - DNA, 10 bp, Saccharomyces cerevisiae
ggtacattca

SEQ ID NO: 129 - DNA, 10 bp, Saccharomyces cerevisiae
gatttctctg

SEQ ID NO: 130 - DNA, 10 bp, Saccharomyces cerevisiae
tagttgctcc

SEQ ID NO: 131 - DNA, 10 bp, Saccharomyces cerevisiae
gtaagaaatc

SEQ ID NO: 132 - DNA, 10 bp, Saccharomyces cerevisiae
cttgggctat

SEQ ID NO: 133 - DNA, 10 bp, Saccharomyces cerevisiae
aaatggtgat

SEQ ID NO: 134 - DNA, 10 bp, Saccharomyces cerevisiae
atcatttggg

SEQ ID NO: 135 - DNA, 10 bp, Saccharomyces cerevisiae
ctgaacttta

SEQ ID NO: 136 - DNA, 10 bp, Saccharomyces cerevisiae
ccagaaggag

SEQ ID NO: 137 - DNA, 10 bp, Saccharomyces cerevisiae
ccggttacta

SEQ ID NO: 138 - DNA, 10 bp, Saccharomyces cerevisiae
cgatgagaag

SEQ ID NO: 139 - DNA, 10 bp, Saccharomyces cerevisiae
aaaccgtccc

SEQ ID NO: 140 - DNA, 10 bp, Saccharomyces cerevisiae
tcattcatac

SEQ ID NO: 141 - DNA, 10 bp, Saccharomyces cerevisiae
tatctttttg

SEQ ID NO: 142 - DNA, 10 bp, Saccharomyces cerevisiae
ttagaataat

SEQ ID NO: 143 - DNA, 10 bp, Saccharomyces cerevisiae
gtacgctgtg

SEQ ID NO: 144 - DNA, 10 bp, Saccharomyces cerevisiae
tatattaatt

SEQ ID NO: 145 - DNA, 10 bp, Saccharomyces cerevisiae
gttcttgcct

SEQ ID NO: 146 - DNA, 10 bp, Saccharomyces cerevisiae
atatagctgc

SEQ ID NO: 147 - DNA, 10 bp, Saccharomyces cerevisiae
ccaaaaaaaa

SEQ ID NO: 148 - DNA, 10 bp, Saccharomyces cerevisiae
gaactccaca

SEQ ID NO: 149 - DNA, 10 bp, Saccharomyces cerevisiae
ccttcactgc

SEQ ID NO: 150 - DNA, 10 bp, Saccharomyces cerevisiae
cacatcataa

SEQ ID NO: 151 - DNA, 10 bp, Saccharomyces cerevisiae
gaagtattga

SEQ ID NO: 152 - DNA, 10 bp, Saccharomyces cerevisiae
tgcgcgtata

SEQ ID NO: 153 - DNA, 10 bp, Saccharomyces cerevisiae
gggtagtact

SEQ ID NO: 154 - DNA, 10 bp, Saccharomyces cerevisiae
tagttttgtc

SEQ ID NO: 155 - DNA, 10 bp, Saccharomyces cerevisiae
caattcctac

SEQ ID NO: 156 - DNA, 10 bp, Saccharomyces cerevisiae
tttgatttga

SEQ ID NO: 157 - DNA, 10 bp, Saccharomyces cerevisiae
ggctctggtt

SEQ ID NO: 158 - DNA, 10 bp, Saccharomyces cerevisiae
cagaaatagc

SEQ ID NO: 159 - DNA, 10 bp, Saccharomyces cerevisiae
ctgttatttt

SEQ ID NO: 160 - DNA, 10 bp, Saccharomyces cerevisiae
cgaagtcaaa

SEQ ID NO: 161 - DNA, 10 bp, Saccharomyces cerevisiae
ctctagataa

SEQ ID NO: 162 - DNA, 10 bp, Saccharomyces cerevisiae
agtcaaaatg

SEQ ID NO: 163 - DNA, 10 bp, Saccharomyces cerevisiae
gcgagtttag

SEQ ID NO: 164 - DNA, 10 bp, Saccharomyces cerevisiae
gctccaatag

SEQ ID NO: 165 - DNA, 10 bp, Saccharomyces cerevisiae
tttatttgag

SEQ ID NO: 166 - DNA, 10 bp, Saccharomyces cerevisiae
gttatattga

SEQ ID NO: 167 - DNA, 10 bp, Saccharomyces cerevisiae
tgggttgaag

SEQ ID NO: 168 - DNA, 10 bp, Saccharomyces cerevisiae
attttatttg

SEQ ID NO: 169 - DNA, 10 bp, Saccharomyces cerevisiae
atcataaaaa

SEQ ID NO: 170 - DNA, 10 bp, Saccharomyces cerevisiae
ttatataaaa

SEQ ID NO: 171 - DNA, 10 bp, Saccharomyces cerevisiae
ctacttctgc

SEQ ID NO: 172 - DNA, 10 bp, Saccharomyces cerevisiae
ataagacagt

SEQ ID NO: 173 - DNA, 10 bp, Saccharomyces cerevisiae
ttcataagtt

SEQ ID NO: 174 - DNA, 10 bp, Saccharomyces cerevisiae
taaatctgag

SEQ ID NO: 175 - DNA, 10 bp, Saccharomyces cerevisiae
ctggtagaaa

SEQ ID NO: 176 - DNA, 10 bp, Saccharomyces cerevisiae
cacgtacaca

SEQ ID NO: 177 - DNA, 10 bp, Saccharomyces cerevisiae
ccaagatcaa

SEQ ID NO: 178 - DNA, 10 bp, Saccharomyces cerevisiae
agcttgttcc

SEQ ID NO: 179 - DNA, 10 bp, Saccharomyces cerevisiae
cacattcgtt

SEQ ID NO: 180 - DNA, 10 bp, Saccharomyces cerevisiae
cttacatata

SEQ ID NO: 181 - DNA, 10 bp, Saccharomyces cerevisiae
tctatagcaa

SEQ ID NO: 182 - DNA, 10 bp, Saccharomyces cerevisiae
cctttctgaa

SEQ ID NO: 183 - DNA, 10 bp, Saccharomyces cerevisiae
cctttagaat

SEQ ID NO: 184 - DNA, 10 bp, Saccharomyces cerevisiae
aattaacacc

SEQ ID NO: 185 - DNA, 10 bp, Saccharomyces cerevisiae
gcgcaggggc

SEQ ID NO: 186 - DNA, 10 bp, Saccharomyces cerevisiae
tgtttataaa

SEQ ID NO: 187 - DNA, 10 bp, Saccharomyces cerevisiae
aaaagtcatt

SEQ ID NO: 188 - DNA, 10 bp, Saccharomyces cerevisiae
ttcgtaaact

SEQ ID NO: 189 - DNA, 10 bp, Saccharomyces cerevisiae
tttttggagt

SEQ ID NO: 190 - DNA, 10 bp, Saccharomyces cerevisiae
aggcatcttg

SEQ ID NO: 191 - DNA, 10 bp, Saccharomyces cerevisiae
aaatcaaaac

SEQ ID NO: 192 - DNA, 10 bp, Saccharomyces cerevisiae
aattgacgaa

SEQ ID NO: 193 - DNA, 10 bp, Saccharomyces cerevisiae
ttgatgattt

SEQ ID NO: 194 - DNA, 10 bp, Saccharomyces cerevisiae
cctgtttttg

SEQ ID NO: 195 - DNA, 10 bp, Saccharomyces cerevisiae
tttttaaaaa

SEQ ID NO: 196 - DNA, 10 bp, Saccharomyces cerevisiae
aagtttgatc

SEQ ID NO: 197 - DNA, 10 bp, Saccharomyces cerevisiae
agcacctatg

SEQ ID NO: 198 - DNA, 10 bp, Saccharomyces cerevisiae
tgatttatcc

SEQ ID NO: 199 - DNA, 10 bp, Saccharomyces cerevisiae
actgcatctg

SEQ ID NO: 200 - DNA, 10 bp, Saccharomyces cerevisiae
caagttagga

SEQ ID NO: 201 - DNA, 10 bp, Saccharomyces cerevisiae
atacccaatt

SEQ ID NO: 202 - DNA, 10 bp, Saccharomyces cerevisiae
aactttgtat

SEQ ID NO: 203 - DNA, 10 bp, Saccharomyces cerevisiae
gcggcgggtg

SEQ ID NO: 204 - DNA, 10 bp, Saccharomyces cerevisiae
aaaattgttc

SEQ ID NO: 205 - DNA, 10 bp, Saccharomyces cerevisiae
tcaagtactc

SEQ ID NO: 206 - DNA, 10 bp, Saccharomyces cerevisiae
aactgtatgc

SEQ ID NO: 207 - DNA, 10 bp, Saccharomyces cerevisiae
ctatcggcca

SEQ ID NO: 208 - DNA, 10 bp, Saccharomyces cerevisiae
acaagcccaa

SEQ ID NO: 209 - DNA, 10 bp, Saccharomyces cerevisiae
gtacagggct

SEQ ID NO: 210 - DNA, 10 bp, Saccharomyces cerevisiae
aagatcatcg

SEQ ID NO: 211 - DNA, 10 bp, Saccharomyces cerevisiae
gaactcctgg

SEQ ID NO: 212 - DNA, 10 bp, Saccharomyces cerevisiae
gaacgagaag

SEQ ID NO: 213 - DNA, 10 bp, Saccharomyces cerevisiae
tttttaatac

SEQ ID NO: 214 - DNA, 10 bp, Saccharomyces cerevisiae
tctccagttg

SEQ ID NO: 215 - DNA, 10 bp, Saccharomyces cerevisiae
aatacgttac

SEQ ID NO: 216 - DNA, 10 bp, Saccharomyces cerevisiae
acgattggct

SEQ ID NO: 217 - DNA, 10 bp, Saccharomyces cerevisiae
tgtttataag

SEQ ID NO: 218 - DNA, 10 bp, Saccharomyces cerevisiae
cgttttcgtc

SEQ ID NO: 219 - DNA, 10 bp, Saccharomyces cerevisiae
tcgaacctct

SEQ ID NO: 220 - DNA, 10 bp, Saccharomyces cerevisiae
tccacacaca

SEQ ID NO: 221 - DNA, 10 bp, Saccharomyces cerevisiae
ccgtgcgtgc

SEQ ID NO: 222 - DNA, 10 bp, Saccharomyces cerevisiae
tttcttcaac

SEQ ID NO: 223 - DNA, 10 bp, Saccharomyces cerevisiae
ccaagtctcg

SEQ ID NO: 224 - DNA, 10 bp, Saccharomyces cerevisiae
agagcgaatt

SEQ ID NO: 225 - DNA, 10 bp, Saccharomyces cerevisiae
tgtagattat

SEQ ID NO: 226 - DNA, 10 bp, Saccharomyces cerevisiae
aaaagtagtt

SEQ ID NO: 227 - DNA, 10 bp, Saccharomyces cerevisiae
acttggtatg

SEQ ID NO: 228 - DNA, 10 bp, Saccharomyces cerevisiae
ttaatgttat

SEQ ID NO: 229 - DNA, 10 bp, Saccharomyces cerevisiae
tacacgcgcg

SEQ ID NO: 230 - DNA, 10 bp, Saccharomyces cerevisiae
ggtcactcct

SEQ ID NO: 231 - DNA, 10 bp, Saccharomyces cerevisiae
aagtgatgaa

SEQ ID NO: 232 - DNA, 10 bp, Saccharomyces cerevisiae
tttatcttgt

SEQ ID NO: 233 - DNA, 10 bp, Saccharomyces cerevisiae
agtgattgtt

SEQ ID NO: 234 - DNA, 10 bp, Saccharomyces cerevisiae
gctttgttgt

SEQ ID NO: 235 - DNA, 10 bp, Saccharomyces cerevisiae
tcattgattc

SEQ ID NO: 236 - DNA, 10 bp, Saccharomyces cerevisiae
ttcaccggaa

SEQ ID NO: 237 - DNA, 10 bp, Saccharomyces cerevisiae
actattctgt

SEQ ID NO: 238 - DNA, 10 bp, Saccharomyces cerevisiae
gggccaaccc

SEQ ID NO: 239 - DNA, 10 bp, Saccharomyces cerevisiae
aaaatatctt

SEQ ID NO: 240 - DNA, 10 bp, Saccharomyces cerevisiae
tagtagtaac

SEQ ID NO: 241 - DNA, 10 bp, Saccharomyces cerevisiae
aagcgcacaa

SEQ ID NO: 242 - DNA, 10 bp, Saccharomyces cerevisiae
tcgctgtttt

SEQ ID NO: 243 - DNA, 10 bp, Saccharomyces cerevisiae
tgtatttttg

SEQ ID NO: 244 - DNA, 10 bp, Saccharomyces cerevisiae
ctaaacaaag

SEQ ID NO: 245 - DNA, 10 bp, Saccharomyces cerevisiae
taggaagaaa

SEQ ID NO: 246 - DNA, 10 bp, Saccharomyces cerevisiae
ggaaaaatta

SEQ ID NO: 247 - DNA, 10 bp, Saccharomyces cerevisiae
tttggatagt

SEQ ID NO: 248 - DNA, 10 bp, Saccharomyces cerevisiae
cgtttgtgta

SEQ ID NO: 249 - DNA, 10 bp, Saccharomyces cerevisiae
agaaaaaaac

SEQ ID NO: 250 - DNA, 10 bp, Saccharomyces cerevisiae
taaagtccag

SEQ ID NO: 251 - DNA, 10 bp, Saccharomyces cerevisiae
taagcagatt

SEQ ID NO: 252 - DNA, 10 bp, Saccharomyces cerevisiae
atgagcattt

SEQ ID NO: 253 - DNA, 10 bp, Saccharomyces cerevisiae
aggtgcaaaa

SEQ ID NO: 254 - DNA, 10 bp, Saccharomyces cerevisiae
taacaaagag

SEQ ID NO: 255 - DNA, 10 bp, Saccharomyces cerevisiae
caattggcaa

SEQ ID NO: 256 - DNA, 10 bp, Saccharomyces cerevisiae
actccctgta

SEQ ID NO: 257 - DNA, 10 bp, Saccharomyces cerevisiae
ctctattgat

SEQ ID NO: 258 - DNA, 10 bp, Saccharomyces cerevisiae
gctttccttt

SEQ ID NO: 259 - DNA, 10 bp, Saccharomyces cerevisiae
accgcaaaga

SEQ ID NO: 260 - DNA, 10 bp, Saccharomyces cerevisiae
cttgttcaaa

SEQ ID NO: 261 - DNA, 10 bp, Saccharomyces cerevisiae
aatgtgctgt

SEQ ID NO: 262 - DNA, 10 bp, Saccharomyces cerevisiae
gcagatagcg

SEQ ID NO: 263 - DNA, 10 bp, Saccharomyces cerevisiae
tctgacttag

SEQ ID NO: 264 - DNA, 10 bp, Saccharomyces cerevisiae
cccggatgtt

SEQ ID NO: 265 - DNA, 10 bp, Saccharomyces cerevisiae
gtaacgattg

SEQ ID NO: 266 - DNA, 10 bp, Saccharomyces cerevisiae
gaataacgaa

SEQ ID NO: 267 - DNA, 10 bp, Saccharomyces cerevisiae
actgctattt

SEQ ID NO: 268 - DNA, 10 bp, Saccharomyces cerevisiae
gttctctagc

SEQ ID NO: 269 - DNA, 10 bp, Saccharomyces cerevisiae
catcaccatc

SEQ ID NO: 270 - DNA, 10 bp, Saccharomyces cerevisiae
ttgcacttct

SEQ ID NO: 271 - DNA, 10 bp, Saccharomyces cerevisiae
actgtttatg

SEQ ID NO: 272 - DNA, 10 bp, Saccharomyces cerevisiae
ttgctatata

SEQ ID NO: 273 - DNA, 10 bp, Saccharomyces cerevisiae
tacattctaa

SEQ ID NO: 274 - DNA, 10 bp, Saccharomyces cerevisiae
ctcttagttg

SEQ ID NO: 275 - DNA, 10 bp, Saccharomyces cerevisiae
acgaacactt

SEQ ID NO: 276 - DNA, 10 bp, Saccharomyces cerevisiae
tgcgcaagtc

SEQ ID NO: 277 - DNA, 10 bp, Saccharomyces cerevisiae
tttttcttaa

SEQ ID NO: 278 - DNA, 10 bp, Saccharomyces cerevisiae
caaatgcatt

SEQ ID NO: 279 - DNA, 10 bp, Saccharomyces cerevisiae
caaattgtgt

SEQ ID NO: 280 - DNA, 10 bp, Saccharomyces cerevisiae
gcaatactat

SEQ ID NO: 281 - DNA, 10 bp, Saccharomyces cerevisiae
agtgacgatg

SEQ ID NO: 282 - DNA, 10 bp, Saccharomyces cerevisiae
tactggttta

SEQ ID NO: 283 - DNA, 10 bp, Saccharomyces cerevisiae
gtttgaccta

SEQ ID NO: 284 - DNA, 10 bp, Saccharomyces cerevisiae
agcgtttgat

SEQ ID NO: 285 - DNA, 10 bp, Saccharomyces cerevisiae
ctctgttgcg

SEQ ID NO: 286 - DNA, 10 bp, Saccharomyces cerevisiae
aaattcaaaa

SEQ ID NO: 287 - DNA, 10 bp, Saccharomyces cerevisiae
tttgcttggt

SEQ ID NO: 288 - DNA, 10 bp, Saccharomyces cerevisiae
agttttcctg

SEQ ID NO: 289 - DNA, 10 bp, Saccharomyces cerevisiae
tttaaagata

SEQ ID NO: 290 - DNA, 10 bp, Saccharomyces cerevisiae
aaggagacac

SEQ ID NO: 291 - DNA, 10 bp, Saccharomyces cerevisiae
ctatatatca

SEQ ID NO: 292 - DNA, 10 bp, Saccharomyces cerevisiae
gatggaatag

SEQ ID NO: 293 - DNA, 10 bp, Saccharomyces cerevisiae
tcgagtcgaa

SEQ ID NO: 294 - DNA, 10 bp, Saccharomyces cerevisiae
aaaaaagaaa

SEQ ID NO: 295 - DNA, 10 bp, Saccharomyces cerevisiae
tttccagaat

SEQ ID NO: 296 - DNA, 10 bp, Saccharomyces cerevisiae
tggacaatgt

SEQ ID NO: 297 - DNA, 10 bp, Saccharomyces cerevisiae
ggaattaaga

SEQ ID NO: 298 - DNA, 10 bp, Saccharomyces cerevisiae
actatatgtt

SEQ ID NO: 299 - DNA, 10 bp, Saccharomyces cerevisiae
gatatatcat

SEQ ID NO: 300 - DNA, 10 bp, Saccharomyces cerevisiae
agaattgatt

SEQ ID NO: 301 - DNA, 10 bp, Saccharomyces cerevisiae
cactgtctcc

SEQ ID NO: 302 - DNA, 10 bp, Saccharomyces cerevisiae
gcattgatgt

SEQ ID NO: 303 - DNA, 10 bp, Saccharomyces cerevisiae
gcattgatgt

SEQ ID NO: 304 - DNA, 10 bp, Saccharomyces cerevisiae
tggtacaagg

SEQ ID NO: 305 - DNA, 10 bp, Saccharomyces cerevisiae
gttttccttt

SEQ ID NO: 306 - DNA, 10 bp, Saccharomyces cerevisiae
aagtttgatc

SEQ ID NO: 307 - DNA, 10 bp, Saccharomyces cerevisiae
aagtttgatc

SEQ ID NO: 308 - DNA, 10 bp, Saccharomyces cerevisiae
aagtttgatc

SEQ ID NO: 309 - DNA, 10 bp, Saccharomyces cerevisiae
cacaccaaga

SEQ ID NO: 310 - DNA, 10 bp, Saccharomyces cerevisiae
cacaccaaga

SEQ ID NO: 311 - DNA, 10 bp, Saccharomyces cerevisiae
gtcaaggttt

SEQ ID NO: 312 - DNA, 10 bp, Saccharomyces cerevisiae
gacccttcct

SEQ ID NO: 313 - DNA, 10 bp, Saccharomyces cerevisiae
gacccttcct

SEQ ID NO: 314 - DNA, 10 bp, Saccharomyces cerevisiae
gacccttcct

SEQ ID NO: 315 - DNA, 10 bp, Saccharomyces cerevisiae
ttgtctttcc

SEQ ID NO: 316 - DNA, 10 bp, Saccharomyces cerevisiae
tcttccaacg

SEQ ID NO: 317 - DNA, 10 bp, Saccharomyces cerevisiae
tcttccaacg

SEQ ID NO: 318 - DNA, 10 bp, Saccharomyces cerevisiae
tcttccaacg

SEQ ID NO: 319 - DNA, 10 bp, Saccharomyces cerevisiae
tcattcatac

SEQ ID NO: 320 - DNA, 10 bp, Saccharomyces cerevisiae
tcttccaacg

SEQ ID NO: 321 - DNA, 10 bp, Saccharomyces cerevisiae
tcattcatac

SEQ ID NO: 322 - DNA, 10 bp, Saccharomyces cerevisiae
tcattcatac

SEQ ID NO: 323 - DNA, 10 bp, Saccharomyces cerevisiae
tcttccaacg

SEQ ID NO: 324 - DNA, 10 bp, Saccharomyces cerevisiae
tcattcatac

SEQ ID NO: 325 - DNA, 10 bp, Saccharomyces cerevisiae
tcattcatac

SEQ ID NO: 326 - DNA, 10 bp, Saccharomyces cerevisiae
tcattcatac

SEQ ID NO: 327 - DNA, 10 bp, Saccharomyces cerevisiae
tcattcatac

SEQ ID NO: 328 - DNA, 10 bp, Saccharomyces cerevisiae
tcattcatac

SEQ ID NO: 329 - DNA, 10 bp, Saccharomyces cerevisiae
gatgtcgacg

SEQ ID NO: 330 - DNA, 10 bp, Saccharomyces cerevisiae
gccaaatcat

SEQ ID NO: 331 - DNA, 10 bp, Saccharomyces cerevisiae
ggagcgtata

SEQ ID NO: 332 - DNA, 10 bp, Saccharomyces cerevisiae
tcatttatga

SEQ ID NO: 333 - DNA, 10 bp, Saccharomyces cerevisiae
agaaaggata

SEQ ID NO: 334 - DNA, 10 bp, Saccharomyces cerevisiae
gatatgctat

SEQ ID NO: 335 - DNA, 10 bp, Saccharomyces cerevisiae
ttttacagtg

SEQ ID NO: 336 - DNA, 10 bp, Saccharomyces cerevisiae
aacgcttttc

SEQ ID NO: 337 - DNA, 10 bp, Saccharomyces cerevisiae
aacgcttttc

SEQ ID NO: 338 - DNA, 10 bp, Saccharomyces cerevisiae
gtacaccaca

SEQ ID NO: 339 - DNA, 10 bp, Saccharomyces cerevisiae
atccaagctg

SEQ ID NO: 340 - DNA, 10 bp, Saccharomyces cerevisiae
tttttttgga

SEQ ID NO: 341 - DNA, 10 bp, Saccharomyces cerevisiae
tttttttgga

SEQ ID NO: 342 - DNA, 10 bp, Saccharomyces cerevisiae
ggacctgccg

SEQ ID NO: 343 - DNA, 10 bp, Saccharomyces cerevisiae
tttttttgga

SEQ ID NO: 344 - DNA, 10 bp, Saccharomyces cerevisiae
tttttttgga

SEQ ID NO: 345 - DNA, 10 bp, Saccharomyces cerevisiae
accctgtcat

SEQ ID NO: 346 - DNA, 10 bp, Saccharomyces cerevisiae
ttctattagg

SEQ ID NO: 347 - DNA, 10 bp, Saccharomyces cerevisiae
tgatttatcc

SEQ ID NO: 348 - DNA, 10 bp, Saccharomyces cerevisiae
tagacatcta

SEQ ID NO: 349 - DNA, 10 bp, Saccharomyces cerevisiae
tagacatcta

SEQ ID NO: 350 - DNA, 10 bp, Saccharomyces cerevisiae
ggctccttat

SEQ ID NO: 351 - DNA, 10 bp, Saccharomyces cerevisiae
aataccaatg

SEQ ID NO: 352 - DNA, 10 bp, Saccharomyces cerevisiae
gaaagctttt

SEQ ID NO: 353 - DNA, 10 bp, Saccharomyces cerevisiae
cagaaatagc

SEQ ID NO: 354 - DNA, 10 bp, Saccharomyces cerevisiae
gaaagtgatg

SEQ ID NO: 355 - DNA, 10 bp, Saccharomyces cerevisiae
gaaagtgatg

SEQ ID NO: 356 - DNA, 10 bp, Saccharomyces cerevisiae
atctgtattt

SEQ ID NO: 357 - DNA, 10 bp, Saccharomyces cerevisiae
atctgtattt

SEQ ID NO: 358 - DNA, 10 bp, Saccharomyces cerevisiae
atggctcagt

SEQ ID NO: 359 - DNA, 10 bp, Saccharomyces cerevisiae
cgaagtcaaa

SEQ ID NO: 360 - DNA, 10 bp, Saccharomyces cerevisiae
cgaagtcaaa

SEQ ID NO: 361 - DNA, 10 bp, Saccharomyces cerevisiae
actgcatctg

SEQ ID NO: 362 - DNA, 10 bp, Saccharomyces cerevisiae
cgaagtcaaa

SEQ ID NO: 363 - DNA, 10 bp, Saccharomyces cerevisiae
cgaagtcaaa

SEQ ID NO: 364 - DNA, 10 bp, Saccharomyces cerevisiae
actgcatctg

SEQ ID NO: 365 - DNA, 10 bp, Saccharomyces cerevisiae
actgcatctg

SEQ ID NO: 366 - DNA, 10 bp, Saccharomyces cerevisiae
caagttagga

SEQ ID NO: 367 - DNA, 10 bp, Saccharomyces cerevisiae
tagtcgctgt

SEQ ID NO: 368 - DNA, 10 bp, Saccharomyces cerevisiae
tagtcgctgt

SEQ ID NO: 369 - DNA, 10 bp, Saccharomyces cerevisiae
ctgaagcaga

SEQ ID NO: 370 - DNA, 10 bp, Saccharomyces cerevisiae
ggttttggcg

SEQ ID NO: 371 - DNA, 10 bp, Saccharomyces cerevisiae
ggttttggcg

SEQ ID NO: 372 - DNA, 10 bp, Saccharomyces cerevisiae
atacccaatt

SEQ ID NO: 373 - DNA, 10 bp, Saccharomyces cerevisiae
aactttgtat

SEQ ID NO: 374 - DNA, 10 bp, Saccharomyces cerevisiae
gcggcgggtg

SEQ ID NO: 375 - DNA, 10 bp, Saccharomyces cerevisiae
atggtagcca

SEQ ID NO: 376 - DNA, 10 bp, Saccharomyces cerevisiae
aaaattgttc

SEQ ID NO: 377 - DNA, 10 bp, Saccharomyces cerevisiae
cggccattat

SEQ ID NO: 378 - DNA, 10 bp, Saccharomyces cerevisiae
gaagaacgtc

SEQ ID NO: 379 - DNA, 10 bp, Saccharomyces cerevisiae
ttgaggaacg

SEQ ID NO: 380 - DNA, 10 bp, Saccharomyces cerevisiae
tcaagtactc

SEQ ID NO: 381 - DNA, 10 bp, Saccharomyces cerevisiae
aataccagcg

SEQ ID NO: 382 - DNA, 10 bp, Saccharomyces cerevisiae
acaagcccaa

SEQ ID NO: 383 - DNA, 10 bp, Saccharomyces cerevisiae
tttaatactg

SEQ ID NO: 384 - DNA, 10 bp, Saccharomyces cerevisiae
gtacagggct

SEQ ID NO: 385 - DNA, 10 bp, Saccharomyces cerevisiae
atatatttag

SEQ ID NO: 386 - DNA, 10 bp, Saccharomyces cerevisiae
gtgaacagtc

SEQ ID NO: 387 - DNA, 10 bp, Saccharomyces cerevisiae
tatctttttg

SEQ ID NO: 388 - DNA, 10 bp, Saccharomyces cerevisiae
ccaaatcaaa

SEQ ID NO: 389 - DNA, 10 bp, Saccharomyces cerevisiae
aagatcatcg

SEQ ID NO: 390 - DNA, 10 bp, Saccharomyces cerevisiae
aagatcatcg

SEQ ID NO: 391 - DNA, 10 bp, Saccharomyces cerevisiae
aagatcatcg

SEQ ID NO: 392 - DNA, 10 bp, Saccharomyces cerevisiae
gctaagaacc

SEQ ID NO: 393 - DNA, 10 bp, Saccharomyces cerevisiae
gctaagaacc

SEQ ID NO: 394 - DNA, 10 bp, Saccharomyces cerevisiae
gctaagaacc

SEQ ID NO: 395 - DNA, 10 bp, Saccharomyces cerevisiae
gaactcctgg

SEQ ID NO: 396 - DNA, 10 bp, Saccharomyces cerevisiae
aggacgttga

SEQ ID NO: 397 - DNA, 10 bp, Saccharomyces cerevisiae
aaatttgggg

SEQ ID NO: 398 - DNA, 10 bp, Saccharomyces cerevisiae
tcagctcaag

SEQ ID NO: 399 - DNA, 10 bp, Saccharomyces cerevisiae
gaattttaga

SEQ ID NO: 400 - DNA, 10 bp, Saccharomyces cerevisiae
gaattttaga

SEQ ID NO: 401 - DNA, 10 bp, Saccharomyces cerevisiae
taattttcat

SEQ ID NO: 402 - DNA, 10 bp, Saccharomyces cerevisiae
gagaagacag

SEQ ID NO: 403 - DNA, 10 bp, Saccharomyces cerevisiae
tttggtggta

SEQ ID NO: 404 - DNA, 10 bp, Saccharomyces cerevisiae
aatacgttac

SEQ ID NO: 405 - DNA, 10 bp, Saccharomyces cerevisiae
aatacgttac

SEQ ID NO: 406 - DNA, 10 bp, Saccharomyces cerevisiae
agcgaatgta

SEQ ID NO: 407 - DNA, 10 bp, Saccharomyces cerevisiae
tgtttataag

SEQ ID NO: 408 - DNA, 10 bp, Saccharomyces cerevisiae
tgtttataag

SEQ ID NO: 409 - DNA, 10 bp, Saccharomyces cerevisiae
cgttttcgtc

SEQ ID NO: 410 - DNA, 10 bp, Saccharomyces cerevisiae
cgttttcgtc

SEQ ID NO: 411 - DNA, 10 bp, Saccharomyces cerevisiae
cgttttcgtc

SEQ ID NO: 412 - DNA, 10 bp, Saccharomyces cerevisiae
cgttttcgtc

SEQ ID NO: 413 - DNA, 10 bp, Saccharomyces cerevisiae
cgttttcgtc

SEQ ID NO: 414 - DNA, 10 bp, Saccharomyces cerevisiae
aagctgagga

SEQ ID NO: 415 - DNA, 10 bp, Saccharomyces cerevisiae
ttgcaaggtg

SEQ ID NO: 416 - DNA, 10 bp, Saccharomyces cerevisiae
ttgcaaggtg

SEQ ID NO: 417 - DNA, 10 bp, Saccharomyces cerevisiae
ctgtctctga

SEQ ID NO: 418 - DNA, 10 bp, Saccharomyces cerevisiae
ctgtctctga

SEQ ID NO: 419 - DNA, 10 bp, Saccharomyces cerevisiae
tccacacaca

SEQ ID NO: 420 - DNA, 10 bp, Saccharomyces cerevisiae
tccacacaca

SEQ ID NO: 421 - DNA, 10 bp, Saccharomyces cerevisiae
tgtctaccaa

SEQ ID NO: 422 - DNA, 10 bp, Saccharomyces cerevisiae
aattgccacc

SEQ ID NO: 423 - DNA, 10 bp, Saccharomyces cerevisiae
ggcgcaattt

SEQ ID NO: 424 - DNA, 10 bp, Saccharomyces cerevisiae
ggcgcaattt

SEQ ID NO: 425 - DNA, 10 bp, Saccharomyces cerevisiae
ctggtcgcga

SEQ ID NO: 426 - DNA, 10 bp, Saccharomyces cerevisiae
ggccaatggt

SEQ ID NO: 427 - DNA, 10 bp, Saccharomyces cerevisiae
ggttttggtt

SEQ ID NO: 428 - DNA, 10 bp, Saccharomyces cerevisiae
ggttttggtt

SEQ ID NO: 429 - DNA, 10 bp, Saccharomyces cerevisiae
tagccaatgc

SEQ ID NO: 430 - DNA, 10 bp, Saccharomyces cerevisiae
aggaaaagaa

SEQ ID NO: 431 - DNA, 10 bp, Saccharomyces cerevisiae
gctaaatttt

SEQ ID NO: 432 - DNA, 10 bp, Saccharomyces cerevisiae
gttatattga

SEQ ID NO: 433 - DNA, 10 bp, Saccharomyces cerevisiae
gaggataacg

SEQ ID NO: 434 - DNA, 10 bp, Saccharomyces cerevisiae
gaggataacg

SEQ ID NO: 435 - DNA, 10 bp, Saccharomyces cerevisiae
aaaagatcat

SEQ ID NO: 436 - DNA, 10 bp, Saccharomyces cerevisiae
aaaagatcat

SEQ ID NO: 437 - DNA, 10 bp, Saccharomyces cerevisiae
ttcgttcact

SEQ ID NO: 438 - DNA, 10 bp, Saccharomyces cerevisiae
ttcgttcact

SEQ ID NO: 439 - DNA, 10 bp, Saccharomyces cerevisiae
ggtacgcaag

SEQ ID NO: 440 - DNA, 10 bp, Saccharomyces cerevisiae
tatattctcg

SEQ ID NO: 441 - DNA, 10 bp, Saccharomyces cerevisiae
tatattctcg

SEQ ID NO: 442 - DNA, 10 bp, Saccharomyces cerevisiae
tgtccttctc

SEQ ID NO: 443 - DNA, 10 bp, Saccharomyces cerevisiae
gtacgctgtg

SEQ ID NO: 444 - DNA, 10 bp, Saccharomyces cerevisiae
gtacgctgtg

SEQ ID NO: 445 - DNA, 10 bp, Saccharomyces cerevisiae
aagatgaagg

SEQ ID NO: 446 - DNA, 10 bp, Saccharomyces cerevisiae
ccaagtctcg

SEQ ID NO: 447 - DNA, 10 bp, Saccharomyces cerevisiae
tgccctggcc

SEQ ID NO: 448 - DNA, 10 bp, Saccharomyces cerevisiae
gtactcctct

SEQ ID NO: 449 - DNA, 10 bp, Saccharomyces cerevisiae
gatttctctg

SEQ ID NO: 450 - DNA, 10 bp, Saccharomyces cerevisiae
gatttctctg

SEQ ID NO: 451 - DNA, 10 bp, Saccharomyces cerevisiae
gatttctctg

SEQ ID NO: 452 - DNA, 10 bp, Saccharomyces cerevisiae
ggactataag

SEQ ID NO: 453 - DNA, 10 bp, Saccharomyces cerevisiae
ggactataag

SEQ ID NO: 454 - DNA, 10 bp, Saccharomyces cerevisiae
tgggttgaag

SEQ ID NO: 455 - DNA, 10 bp, Saccharomyces cerevisiae
tgggttgaag

SEQ ID NO: 456 - DNA, 10 bp, Saccharomyces cerevisiae
ggactataag

SEQ ID NO: 457 - DNA, 10 bp, Saccharomyces cerevisiae
tgggttgaag

SEQ ID NO: 458 - DNA, 10 bp, Saccharomyces cerevisiae
cgagacttgg

SEQ ID NO: 459 - DNA, 10 bp, Saccharomyces cerevisiae
aaaagtagtt

SEQ ID NO: 460 - DNA, 10 bp, Saccharomyces cerevisiae
aaaagtagtt

SEQ ID NO: 461 - DNA, 10 bp, Saccharomyces cerevisiae
aaaagtagtt

SEQ ID NO: 462 - DNA, 10 bp, Saccharomyces cerevisiae
aaaagtagtt

SEQ ID NO: 463 - DNA, 10 bp, Saccharomyces cerevisiae
aaaagtagtt

SEQ ID NO: 464 - DNA, 10 bp, Saccharomyces cerevisiae
gcaacaaaag

SEQ ID NO: 465 - DNA, 10 bp, Saccharomyces cerevisiae
gttcgaaaac

SEQ ID NO: 466 - DNA, 10 bp, Saccharomyces cerevisiae
cccatagtgg

SEQ ID NO: 467 - DNA, 10 bp, Saccharomyces cerevisiae
gaagagaatg

SEQ ID NO: 468 - DNA, 10 bp, Saccharomyces cerevisiae
gatgccgaaa

SEQ ID NO: 469 - DNA, 10 bp, Saccharomyces cerevisiae
attttatttg

SEQ ID NO: 470 - DNA, 10 bp, Saccharomyces cerevisiae
attttatttg

SEQ ID NO: 471 - DNA, 10 bp, Saccharomyces cerevisiae
gcagaatgct

SEQ ID NO: 472 - DNA, 10 bp, Saccharomyces cerevisiae
atcataaaaa

SEQ ID NO: 473 - DNA, 10 bp, Saccharomyces cerevisiae
atcataaaaa

SEQ ID NO: 474 - DNA, 10 bp, Saccharomyces cerevisiae
gacaattttt

SEQ ID NO: 475 - DNA, 10 bp, Saccharomyces cerevisiae
aagtgatgaa

SEQ ID NO: 476 - DNA, 10 bp, Saccharomyces cerevisiae
aagtgatgaa

SEQ ID NO: 477 - DNA, 10 bp, Saccharomyces cerevisiae
ggtgtgaagg

SEQ ID NO: 478 - DNA, 10 bp, Saccharomyces cerevisiae
ggtgtgaagg

SEQ ID NO: 479 - DNA, 10 bp, Saccharomyces cerevisiae
ggtgtgaagg

SEQ ID NO: 480 - DNA, 10 bp, Saccharomyces cerevisiae
agtgattgtt

SEQ ID NO: 481 - DNA, 10 bp, Saccharomyces cerevisiae
agtgattgtt

SEQ ID NO: 482 - DNA, 10 bp, Saccharomyces cerevisiae
gtgatgaact

SEQ ID NO: 483 - DNA, 10 bp, Saccharomyces cerevisiae
tgccagactc

SEQ ID NO: 484 - DNA, 10 bp, Saccharomyces cerevisiae
aaagatccga

SEQ ID NO: 485 - DNA, 10 bp, Saccharomyces cerevisiae
tggcacctca

SEQ ID NO: 486 - DNA, 10 bp, Saccharomyces cerevisiae
ttcaccggaa

SEQ ID NO: 487 - DNA, 10 bp, Saccharomyces cerevisiae
ttcaccggaa

SEQ ID NO: 488 - DNA, 10 bp, Saccharomyces cerevisiae
gctttgattg

SEQ ID NO: 489 - DNA, 10 bp, Saccharomyces cerevisiae
ataacgaaaa

SEQ ID NO: 490 - DNA, 10 bp, Saccharomyces cerevisiae
actattctgt

SEQ ID NO: 491 - DNA, 10 bp, Saccharomyces cerevisiae
atttaaaaca

SEQ ID NO: 492 - DNA, 10 bp, Saccharomyces cerevisiae
cgcctccagt

SEQ ID NO: 493 - DNA, 10 bp, Saccharomyces cerevisiae
gccaagaact

SEQ ID NO: 494 - DNA, 10 bp, Saccharomyces cerevisiae
tttattcaat

SEQ ID NO: 495 - DNA, 10 bp, Saccharomyces cerevisiae
aaagacagag

SEQ ID NO: 496 - DNA, 10 bp, Saccharomyces cerevisiae
aaagacagag

SEQ ID NO: 497 - DNA, 10 bp, Saccharomyces cerevisiae
aaaatatctt

SEQ ID NO: 498 - DNA, 10 bp, Saccharomyces cerevisiae
taaggagttt

SEQ ID NO: 499 - DNA, 10 bp, Saccharomyces cerevisiae
caacaaggta

SEQ ID NO: 500 - DNA, 10 bp, Saccharomyces cerevisiae
agcccgtttt

SEQ ID NO: 501 - DNA, 10 bp, Saccharomyces cerevisiae
aagcgcacaa

SEQ ID NO: 502 - DNA, 10 bp, Saccharomyces cerevisiae
tatgatgtga

SEQ ID NO: 503 - DNA, 10 bp, Saccharomyces cerevisiae
gtaagaaatc

SEQ ID NO: 504 - DNA, 10 bp, Saccharomyces cerevisiae
gtaagaaatc

SEQ ID NO: 505 - DNA, 10 bp, Saccharomyces cerevisiae
tgtatttttg

SEQ ID NO: 506 - DNA, 10 bp, Saccharomyces cerevisiae
tgtatttttg

SEQ ID NO: 507 - DNA, 10 bp, Saccharomyces cerevisiae
gtaagaaatc

SEQ ID NO: 508 - DNA, 10 bp, Saccharomyces cerevisiae
ctaaacaaag

SEQ ID NO: 509 - DNA, 10 bp, Saccharomyces cerevisiae
tgtatttttg

SEQ ID NO: 510 - DNA, 10 bp, Saccharomyces cerevisiae
gtaagaaatc

SEQ ID NO: 511 - DNA, 10 bp, Saccharomyces cerevisiae
ctaaacaaag

SEQ ID NO: 512 - DNA, 10 bp, Saccharomyces cerevisiae
gtaagaaatc

SEQ ID NO: 513 - DNA, 10 bp, Saccharomyces cerevisiae
ctaaacaaag

SEQ ID NO: 514 - DNA, 10 bp, Saccharomyces cerevisiae
acgttctttt

SEQ ID NO: 515 - DNA, 10 bp, Saccharomyces cerevisiae
gatatcttta

SEQ ID NO: 516 - DNA, 10 bp, Saccharomyces cerevisiae
tatggtaaat

SEQ ID NO: 517 - DNA, 10 bp, Saccharomyces cerevisiae
taggaagaaa

SEQ ID NO: 518 - DNA, 10 bp, Saccharomyces cerevisiae
taggaagaaa

SEQ ID NO: 519 - DNA, 10 bp, Saccharomyces cerevisiae
taggaagaaa

SEQ ID NO: 520 - DNA, 10 bp, Saccharomyces cerevisiae
gttcttgcct

SEQ ID NO: 521 - DNA, 10 bp, Saccharomyces cerevisiae
gttcttgcct

SEQ ID NO: 522 - DNA, 10 bp, Saccharomyces cerevisiae
gttcttgcct

SEQ ID NO: 523 - DNA, 10 bp, Saccharomyces cerevisiae
ggaaaaatta

SEQ ID NO: 524 - DNA, 10 bp, Saccharomyces cerevisiae
ggaaaaatta

SEQ ID NO: 525 - DNA, 10 bp, Saccharomyces cerevisiae
ggaaaaatta

SEQ ID NO: 526 - DNA, 10 bp, Saccharomyces cerevisiae
gtccataagc

SEQ ID NO: 527 - DNA, 10 bp, Saccharomyces cerevisiae
aatcttgaga

SEQ ID NO: 528 - DNA, 10 bp, Saccharomyces cerevisiae
aatcttgaga

SEQ ID NO: 529 - DNA, 10 bp, Saccharomyces cerevisiae
aatcttgaga

SEQ ID NO: 530 - DNA, 10 bp, Saccharomyces cerevisiae
aatcttgaga

SEQ ID NO: 531 - DNA, 10 bp, Saccharomyces cerevisiae
tttggatagt

SEQ ID NO: 532 - DNA, 10 bp, Saccharomyces cerevisiae
agagagatgt

SEQ ID NO: 533 - DNA, 10 bp, Saccharomyces cerevisiae
ctacttctgc

SEQ ID NO: 534 - DNA, 10 bp, Saccharomyces cerevisiae
cagaaaatgg

SEQ ID NO: 535 - DNA, 10 bp, Saccharomyces cerevisiae
cagaaaatgg

SEQ ID NO: 536 - DNA, 10 bp, Saccharomyces cerevisiae
cgtttgtgta

SEQ ID NO: 537 - DNA, 10 bp, Saccharomyces cerevisiae
cgtttgtgta

SEQ ID NO: 538 - DNA, 10 bp, Saccharomyces cerevisiae
cgtttgtgta

SEQ ID NO: 539 - DNA, 10 bp, Saccharomyces cerevisiae
cgtttgtgta

SEQ ID NO: 540 - DNA, 10 bp, Saccharomyces cerevisiae
cgtttgtgta

SEQ ID NO: 541 - DNA, 10 bp, Saccharomyces cerevisiae
aaggacttta

SEQ ID NO: 542 - DNA, 10 bp, Saccharomyces cerevisiae
attgcatctc

SEQ ID NO: 543 - DNA, 10 bp, Saccharomyces cerevisiae
agaaaaaaac

SEQ ID NO: 544 - DNA, 10 bp, Saccharomyces cerevisiae
ttagtgaagg

SEQ ID NO: 545 - DNA, 10 bp, Saccharomyces cerevisiae
taaagtccag

SEQ ID NO: 546 - DNA, 10 bp, Saccharomyces cerevisiae
taagcagatt

SEQ ID NO: 547 - DNA, 10 bp, Saccharomyces cerevisiae
taagcagatt

SEQ ID NO: 548 - DNA, 10 bp, Saccharomyces cerevisiae
aagcggtact

SEQ ID NO: 549 - DNA, 10 bp, Saccharomyces cerevisiae
aagcggtact

SEQ ID NO: 550 - DNA, 10 bp, Saccharomyces cerevisiae
ctctccccca

SEQ ID NO: 551 - DNA, 10 bp, Saccharomyces cerevisiae
attcgcagat

SEQ ID NO: 552 - DNA, 10 bp, Saccharomyces cerevisiae
agaacatcaa

SEQ ID NO: 553 - DNA, 10 bp, Saccharomyces cerevisiae
tttcaagatg

SEQ ID NO: 554 - DNA, 10 bp, Saccharomyces cerevisiae
acgctcccaa

SEQ ID NO: 555 - DNA, 10 bp, Saccharomyces cerevisiae
actttttcag

SEQ ID NO: 556 - DNA, 10 bp, Saccharomyces cerevisiae
atatagctgc

SEQ ID NO: 557 - DNA, 10 bp, Saccharomyces cerevisiae
atatagctgc

SEQ ID NO: 558 - DNA, 10 bp, Saccharomyces cerevisiae
cttcagaatg

SEQ ID NO: 559 - DNA, 10 bp, Saccharomyces cerevisiae
gggttctcta

SEQ ID NO: 560 - DNA, 10 bp, Saccharomyces cerevisiae
acaaaatttg

SEQ ID NO: 561 - DNA, 10 bp, Saccharomyces cerevisiae
tactctcgtt

SEQ ID NO: 562 - DNA, 10 bp, Saccharomyces cerevisiae
taagcggagt

SEQ ID NO: 563 - DNA, 10 bp, Saccharomyces cerevisiae
ggcttctcta

SEQ ID NO: 564 - DNA, 10 bp, Saccharomyces cerevisiae
ttcataagtt

SEQ ID NO: 565 - DNA, 10 bp, Saccharomyces cerevisiae
ttcataagtt

SEQ ID NO: 566 - DNA, 10 bp, Saccharomyces cerevisiae
ttcataagtt

SEQ ID NO: 567 - DNA, 10 bp, Saccharomyces cerevisiae
taattagtta

SEQ ID NO: 568 - DNA, 10 bp, Saccharomyces cerevisiae
gccgaattct

SEQ ID NO: 569 - DNA, 10 bp, Saccharomyces cerevisiae
tcttacaata

SEQ ID NO: 570 - DNA, 10 bp, Saccharomyces cerevisiae
tcttacaata

SEQ ID NO: 571 - DNA, 10 bp, Saccharomyces cerevisiae
aatgtggaac

SEQ ID NO: 572 - DNA, 10 bp, Saccharomyces cerevisiae
ggtaacgtaa

SEQ ID NO: 573 - DNA, 10 bp, Saccharomyces cerevisiae
tctccgtaca

SEQ ID NO: 574 - DNA, 10 bp, Saccharomyces cerevisiae
caattggcaa

SEQ ID NO: 575 - DNA, 10 bp, Saccharomyces cerevisiae
caattggcaa

SEQ ID NO: 576 - DNA, 10 bp, Saccharomyces cerevisiae
attctggatc

SEQ ID NO: 577 - DNA, 10 bp, Saccharomyces cerevisiae
attctggatc

SEQ ID NO: 578 - DNA, 10 bp, Saccharomyces cerevisiae
gcgtcctccc

SEQ ID NO: 579 - DNA, 10 bp, Saccharomyces cerevisiae
ccaaaaaaaa

SEQ ID NO: 580 - DNA, 10 bp, Saccharomyces cerevisiae
ccaaaaaaaa

SEQ ID NO: 581 - DNA, 10 bp, Saccharomyces cerevisiae
ccaaaaaaaa

SEQ ID NO: 582 - DNA, 10 bp, Saccharomyces cerevisiae
gaactccaca

SEQ ID NO: 583 - DNA, 10 bp, Saccharomyces cerevisiae
gaactccaca

SEQ ID NO: 584 - DNA, 10 bp, Saccharomyces cerevisiae
actccctgta

SEQ ID NO: 585 - DNA, 10 bp, Saccharomyces cerevisiae
actccctgta

SEQ ID NO: 586 - DNA, 10 bp, Saccharomyces cerevisiae
actccctgta

SEQ ID NO: 587 - DNA, 10 bp, Saccharomyces cerevisiae
gaactccaca

SEQ ID NO: 588 - DNA, 10 bp, Saccharomyces cerevisiae
gaactccaca

SEQ ID NO: 589 - DNA, 10 bp, Saccharomyces cerevisiae
actccctgta

SEQ ID NO: 590 - DNA, 10 bp, Saccharomyces cerevisiae
ctctattgat

SEQ ID NO: 591 - DNA, 10 bp, Saccharomyces cerevisiae
ctctattgat

SEQ ID NO: 592 - DNA, 10 bp, Saccharomyces cerevisiae
taaatctgag

SEQ ID NO: 593 - DNA, 10 bp, Saccharomyces cerevisiae
gctttccttt

SEQ ID NO: 594 - DNA, 10 bp, Saccharomyces cerevisiae
gctttccttt

SEQ ID NO: 595 - DNA, 10 bp, Saccharomyces cerevisiae
ctggtagaaa

SEQ ID NO: 596 - DNA, 10 bp, Saccharomyces cerevisiae
aacaagattg

SEQ ID NO: 597 - DNA, 10 bp, Saccharomyces cerevisiae
aacaagattg

SEQ ID NO: 598 - DNA, 10 bp, Saccharomyces cerevisiae
tctgtgaaac

SEQ ID NO: 599 - DNA, 10 bp, Saccharomyces cerevisiae
tctgtgaaac

SEQ ID NO: 600 - DNA, 10 bp, Saccharomyces cerevisiae
tctgtgaaac

SEQ ID NO: 601 - DNA, 10 bp, Saccharomyces cerevisiae
tctgtgaaac

SEQ ID NO: 602 - DNA, 10 bp, Saccharomyces cerevisiae
gaggcaaaaa

SEQ ID NO: 603 - DNA, 10 bp, Saccharomyces cerevisiae
accgcaaaga

SEQ ID NO: 604 - DNA, 10 bp, Saccharomyces cerevisiae
tctattgtca

SEQ ID NO: 605 - DNA, 10 bp, Saccharomyces cerevisiae
ccttcactgc

SEQ ID NO: 606 - DNA, 10 bp, Saccharomyces cerevisiae
ctgttttggg

SEQ ID NO: 607 - DNA, 10 bp, Saccharomyces cerevisiae
ccttcactgc

SEQ ID NO: 608 - DNA, 10 bp, Saccharomyces cerevisiae
ccttcactgc

SEQ ID NO: 609 - DNA, 10 bp, Saccharomyces cerevisiae
ctgttttggg

SEQ ID NO: 610 - DNA, 10 bp, Saccharomyces cerevisiae
tttaaaaaaa

SEQ ID NO: 611 - DNA, 10 bp, Saccharomyces cerevisiae
ttagagagac

SEQ ID NO: 612 - DNA, 10 bp, Saccharomyces cerevisiae
tactttaaac

SEQ ID NO: 613 - DNA, 10 bp, Saccharomyces cerevisiae
ggtgatgagg

SEQ ID NO: 614 - DNA, 10 bp, Saccharomyces cerevisiae
gttcaagagg

SEQ ID NO: 615 - DNA, 10 bp, Saccharomyces cerevisiae
agaacttcgt

SEQ ID NO: 616 - DNA, 10 bp, Saccharomyces cerevisiae
agaacttcgt

SEQ ID NO: 617 - DNA, 10 bp, Saccharomyces cerevisiae
agaacttcgt

SEQ ID NO: 618 - DNA, 10 bp, Saccharomyces cerevisiae
gttccaagac

SEQ ID NO: 619 - DNA, 10 bp, Saccharomyces cerevisiae
tacctcgtta

SEQ ID NO: 620 - DNA, 10 bp, Saccharomyces cerevisiae
tacctcgtta

SEQ ID NO: 621 - DNA, 10 bp, Saccharomyces cerevisiae
cacatcataa

SEQ ID NO: 622 - DNA, 10 bp, Saccharomyces cerevisiae
atcatttggg

SEQ ID NO: 623 - DNA, 10 bp, Saccharomyces cerevisiae
cttgttcaaa

SEQ ID NO: 624 - DNA, 10 bp, Saccharomyces cerevisiae
cttgttcaaa

SEQ ID NO: 625 - DNA, 10 bp, Saccharomyces cerevisiae
cttgttcaaa

SEQ ID NO: 626 - DNA, 10 bp, Saccharomyces cerevisiae
cttgttcaaa

SEQ ID NO: 627 - DNA, 10 bp, Saccharomyces cerevisiae
gagactgcta

SEQ ID NO: 628 - DNA, 10 bp, Saccharomyces cerevisiae
ataatggaac

SEQ ID NO: 629 - DNA, 10 bp, Saccharomyces cerevisiae
aatgtgctgt

SEQ ID NO: 630 - DNA, 10 bp, Saccharomyces cerevisiae
aatgtgctgt

SEQ ID NO: 631 - DNA, 10 bp, Saccharomyces cerevisiae
aatgtgctgt

SEQ ID NO: 632 - DNA, 10 bp, Saccharomyces cerevisiae
aatgtgctgt

SEQ ID NO: 633 - DNA, 10 bp, Saccharomyces cerevisiae
gcagatagcg

SEQ ID NO: 634 - DNA, 10 bp, Saccharomyces cerevisiae
gcagatagcg

SEQ ID NO: 635 - DNA, 10 bp, Saccharomyces cerevisiae
gcagatagcg

SEQ ID NO: 636 - DNA, 10 bp, Saccharomyces cerevisiae
gcagatagcg

SEQ ID NO: 637 - DNA, 10 bp, Saccharomyces cerevisiae
gcagatagcg

SEQ ID NO: 638 - DNA, 10 bp, Saccharomyces cerevisiae
gaaagctaga

SEQ ID NO: 639 - DNA, 10 bp, Saccharomyces cerevisiae
gaaagctaga

SEQ ID NO: 640 - DNA, 10 bp, Saccharomyces cerevisiae
tctgacttag

SEQ ID NO: 641 - DNA, 10 bp, Saccharomyces cerevisiae
gccgttcgat

SEQ ID NO: 642 - DNA, 10 bp, Saccharomyces cerevisiae
gtaacgattg

SEQ ID NO: 643 - DNA, 10 bp, Saccharomyces cerevisiae
gtaacgattg

SEQ ID NO: 644 - DNA, 10 bp, Saccharomyces cerevisiae
gtaacgattg

SEQ ID NO: 645 - DNA, 10 bp, Saccharomyces cerevisiae
gtaacgattg

SEQ ID NO: 646 - DNA, 10 bp, Saccharomyces cerevisiae
ccgaaacagg

SEQ ID NO: 647 - DNA, 10 bp, Saccharomyces cerevisiae
tctagtcgcc

SEQ ID NO: 648 - DNA, 10 bp, Saccharomyces cerevisiae
tctagtcgcc

SEQ ID NO: 649 - DNA, 10 bp, Saccharomyces cerevisiae
ttgctaaaga

SEQ ID NO: 650 - DNA, 10 bp, Saccharomyces cerevisiae
tttacgataa

SEQ ID NO: 651 - DNA, 10 bp, Saccharomyces cerevisiae
tcaaacatcc

SEQ ID NO: 652 - DNA, 10 bp, Saccharomyces cerevisiae
catcaccatc

SEQ ID NO: 653 - DNA, 10 bp, Saccharomyces cerevisiae
catcaccatc

SEQ ID NO: 654 - DNA, 10 bp, Saccharomyces cerevisiae
aaggacagag

SEQ ID NO: 655 - DNA, 10 bp, Saccharomyces cerevisiae
ccttgtggga

SEQ ID NO: 656 - DNA, 10 bp, Saccharomyces cerevisiae
ccttgtggga

SEQ ID NO: 657 - DNA, 10 bp, Saccharomyces cerevisiae
ccttgtggga

SEQ ID NO: 658 - DNA, 10 bp, Saccharomyces cerevisiae
tgcctcagga

SEQ ID NO: 659 - DNA, 10 bp, Saccharomyces cerevisiae
ttgaaaagat

SEQ ID NO: 660 - DNA, 10 bp, Saccharomyces cerevisiae
cttctctttt

SEQ ID NO: 661 - DNA, 10 bp, Saccharomyces cerevisiae
gtcatatagt

SEQ ID NO: 662 - DNA, 10 bp, Saccharomyces cerevisiae
ctcttagttg

SEQ ID NO: 663 - DNA, 10 bp, Saccharomyces cerevisiae
cttctctttt

SEQ ID NO: 664 - DNA, 10 bp, Saccharomyces cerevisiae
gtcatatagt

SEQ ID NO: 665 - DNA, 10 bp, Saccharomyces cerevisiae
ctcttagttg

SEQ ID NO: 666 - DNA, 10 bp, Saccharomyces cerevisiae
gtcatatagt

SEQ ID NO: 667 - DNA, 10 bp, Saccharomyces cerevisiae
ctcttagttg

SEQ ID NO: 668 - DNA, 10 bp, Saccharomyces cerevisiae
gtcatatagt

SEQ ID NO: 669 - DNA, 10 bp, Saccharomyces cerevisiae
ctcttagttg

SEQ ID NO: 670 - DNA, 10 bp, Saccharomyces cerevisiae
gaagcctgtt

SEQ ID NO: 671 - DNA, 10 bp, Saccharomyces cerevisiae
gaagcctgtt

SEQ ID NO: 672 - DNA, 10 bp, Saccharomyces cerevisiae
tctatagcaa

SEQ ID NO: 673 - DNA, 10 bp, Saccharomyces cerevisiae
tgcgcaagtc

SEQ ID NO: 674 - DNA, 10 bp, Saccharomyces cerevisiae
tgcgcaagtc

SEQ ID NO: 675 - DNA, 10 bp, Saccharomyces cerevisiae
cctttctgaa

SEQ ID NO: 676 - DNA, 10 bp, Saccharomyces cerevisiae
cctttctgaa

SEQ ID NO: 677 - DNA, 10 bp, Saccharomyces cerevisiae
cctttctgaa

SEQ ID NO: 678 - DNA, 10 bp, Saccharomyces cerevisiae
cctttctgaa

SEQ ID NO: 679 - DNA, 10 bp, Saccharomyces cerevisiae
ggttccggta

SEQ ID NO: 680 - DNA, 10 bp, Saccharomyces cerevisiae
gaaaaggtca

SEQ ID NO: 681 - DNA, 10 bp, Saccharomyces cerevisiae
tttttcttaa

SEQ ID NO: 682 - DNA, 10 bp, Saccharomyces cerevisiae
tttcctataa

SEQ ID NO: 683 - DNA, 10 bp, Saccharomyces cerevisiae
tttcctataa

SEQ ID NO: 684 - DNA, 10 bp, Saccharomyces cerevisiae
caatggccca

SEQ ID NO: 685 - DNA, 10 bp, Saccharomyces cerevisiae
tttcctataa

SEQ ID NO: 686 - DNA, 10 bp, Saccharomyces cerevisiae
tttcctataa

SEQ ID NO: 687 - DNA, 10 bp, Saccharomyces cerevisiae
caatggccca

SEQ ID NO: 688 - DNA, 10 bp, Saccharomyces cerevisiae
caatggccca

SEQ ID NO: 689 - DNA, 10 bp, Saccharomyces cerevisiae
ggcaacagca

SEQ ID NO: 690 - DNA, 10 bp, Saccharomyces cerevisiae
ggcaacagca

SEQ ID NO: 691 - DNA, 10 bp, Saccharomyces cerevisiae
ccagaaggag

SEQ ID NO: 692 - DNA, 10 bp, Saccharomyces cerevisiae
ccagaaggag

SEQ ID NO: 693 - DNA, 10 bp, Saccharomyces cerevisiae
ccagaaggag

SEQ ID NO: 694 - DNA, 10 bp, Saccharomyces cerevisiae
ccagaaggag

SEQ ID NO: 695 - DNA, 10 bp, Saccharomyces cerevisiae
ccagaaggag

SEQ ID NO: 696 - DNA, 10 bp, Saccharomyces cerevisiae
gctgccagac

SEQ ID NO: 697 - DNA, 10 bp, Saccharomyces cerevisiae
gtgggaaagg

SEQ ID NO: 698 - DNA, 10 bp, Saccharomyces cerevisiae
gcaatactat

SEQ ID NO: 699 - DNA, 10 bp, Saccharomyces cerevisiae
aattaacacc

SEQ ID NO: 700 - DNA, 10 bp, Saccharomyces cerevisiae
cgcaggttac

SEQ ID NO: 701 - DNA, 10 bp, Saccharomyces cerevisiae
agtgacgatg

SEQ ID NO: 702 - DNA, 10 bp, Saccharomyces cerevisiae
agtgacgatg

SEQ ID NO: 703 - DNA, 10 bp, Saccharomyces cerevisiae
agtgacgatg

SEQ ID NO: 704 - DNA, 10 bp, Saccharomyces cerevisiae
agtgacgatg

SEQ ID NO: 705 - DNA, 10 bp, Saccharomyces cerevisiae
agtgacgatg

SEQ ID NO: 706 - DNA, 10 bp, Saccharomyces cerevisiae
agtgacgatg

SEQ ID NO: 707 - DNA, 10 bp, Saccharomyces cerevisiae
gcagaagaac

SEQ ID NO: 708 - DNA, 10 bp, Saccharomyces cerevisiae
gataccttca

SEQ ID NO: 709 - DNA, 10 bp, Saccharomyces cerevisiae
gataccttca

SEQ ID NO: 710 - DNA, 10 bp, Saccharomyces cerevisiae
ggttttaagt

SEQ ID NO: 711 - DNA, 10 bp, Saccharomyces cerevisiae
ttcacccttc

SEQ ID NO: 712 - DNA, 10 bp, Saccharomyces cerevisiae
gtttgaccta

SEQ ID NO: 713 - DNA, 10 bp, Saccharomyces cerevisiae
gtttgaccta

SEQ ID NO: 714 - DNA, 10 bp, Saccharomyces cerevisiae
gtttgaccta

SEQ ID NO: 715 - DNA, 10 bp, Saccharomyces cerevisiae
catcagcaac

SEQ ID NO: 716 - DNA, 10 bp, Saccharomyces cerevisiae
aaggctaatg

SEQ ID NO: 717 - DNA, 10 bp, Saccharomyces cerevisiae
gcaggagaag

SEQ ID NO: 718 - DNA, 10 bp, Saccharomyces cerevisiae
tgtctggtgt

SEQ ID NO: 719 - DNA, 10 bp, Saccharomyces cerevisiae
tgtctggtgt

SEQ ID NO: 720 - DNA, 10 bp, Saccharomyces cerevisiae
tgtctggtgt

SEQ ID NO: 721 - DNA, 10 bp, Saccharomyces cerevisiae
tgtttataaa

SEQ ID NO: 722 - DNA, 10 bp, Saccharomyces cerevisiae
tgtttataaa

SEQ ID NO: 723 - DNA, 10 bp, Saccharomyces cerevisiae
aaaagtcatt

SEQ ID NO: 724 - DNA, 10 bp, Saccharomyces cerevisiae
tagttttgtc

SEQ ID NO: 725 - DNA, 10 bp, Saccharomyces cerevisiae
tagttttgtc

SEQ ID NO: 726 - DNA, 10 bp, Saccharomyces cerevisiae
tagttttgtc

SEQ ID NO: 727 - DNA, 10 bp, Saccharomyces cerevisiae
tagttttgtc

SEQ ID NO: 728 - DNA, 10 bp, Saccharomyces cerevisiae
aaattcaaaa

SEQ ID NO: 729 - DNA, 10 bp, Saccharomyces cerevisiae
ttttccaaaa

SEQ ID NO: 730 - DNA, 10 bp, Saccharomyces cerevisiae
tttgcttggt

SEQ ID NO: 731 - DNA, 10 bp, Saccharomyces cerevisiae
tttgcttggt

SEQ ID NO: 732 - DNA, 10 bp, Saccharomyces cerevisiae
tggtgttgtc

SEQ ID NO: 733 - DNA, 10 bp, Saccharomyces cerevisiae
gatttaaact

SEQ ID NO: 734 - DNA, 10 bp, Saccharomyces cerevisiae
atgctcggct

SEQ ID NO: 735 - DNA, 10 bp, Saccharomyces cerevisiae
atgctcggct

SEQ ID NO: 736 - DNA, 10 bp, Saccharomyces cerevisiae
agttttcctg

SEQ ID NO: 737 - DNA, 10 bp, Saccharomyces cerevisiae
agttttcctg

SEQ ID NO: 738 - DNA, 10 bp, Saccharomyces cerevisiae
agttttcctg

SEQ ID NO: 739 - DNA, 10 bp, Saccharomyces cerevisiae
agttttcctg

SEQ ID NO: 740 - DNA, 10 bp, Saccharomyces cerevisiae
aatgctccag

SEQ ID NO: 741 - DNA, 10 bp, Saccharomyces cerevisiae
gctttgctaa

SEQ ID NO: 742 - DNA, 10 bp, Saccharomyces cerevisiae
acgaaaatcc

SEQ ID NO: 743 - DNA, 10 bp, Saccharomyces cerevisiae
tcttgaaaag

SEQ ID NO: 744 - DNA, 10 bp, Saccharomyces cerevisiae
tcttgaaaag

SEQ ID NO: 745 - DNA, 10 bp, Saccharomyces cerevisiae
aaggagacac

SEQ ID NO: 746 - DNA, 10 bp, Saccharomyces cerevisiae
tttcaggcaa

SEQ ID NO: 747 - DNA, 10 bp, Saccharomyces cerevisiae
tttcaggcaa

SEQ ID NO: 748 - DNA, 10 bp, Saccharomyces cerevisiae
ctatatatca

SEQ ID NO: 749 - DNA, 10 bp, Saccharomyces cerevisiae
gatggaatag

SEQ ID NO: 750 - DNA, 10 bp, Saccharomyces cerevisiae
gatggaatag

SEQ ID NO: 751 - DNA, 10 bp, Saccharomyces cerevisiae
gataacaaaa

SEQ ID NO: 752 - DNA, 10 bp, Saccharomyces cerevisiae
agcatcggtg

SEQ ID NO: 753 - DNA, 10 bp, Saccharomyces cerevisiae
agcatcggtg

SEQ ID NO: 754 - DNA, 10 bp, Saccharomyces cerevisiae
ggacaatcag

SEQ ID NO: 755 - DNA, 10 bp, Saccharomyces cerevisiae
tctgtcgaaa

SEQ ID NO: 756 - DNA, 10 bp, Saccharomyces cerevisiae
acggaaaaga

SEQ ID NO: 757 - DNA, 10 bp, Saccharomyces cerevisiae
ggtggattct

SEQ ID NO: 758 - DNA, 10 bp, Saccharomyces cerevisiae
ccggttacta

SEQ ID NO: 759 - DNA, 10 bp, Saccharomyces cerevisiae
agcgtcctca

SEQ ID NO: 760 - DNA, 10 bp, Saccharomyces cerevisiae
agcgtcctca

SEQ ID NO: 761 - DNA, 10 bp, Saccharomyces cerevisiae
attcgttcta

SEQ ID NO: 762 - DNA, 10 bp, Saccharomyces cerevisiae
atcgttttat

SEQ ID NO: 763 - DNA, 10 bp, Saccharomyces cerevisiae
atggtggcgt

SEQ ID NO: 764 - DNA, 10 bp, Saccharomyces cerevisiae
tttccagaat

SEQ ID NO: 765 - DNA, 10 bp, Saccharomyces cerevisiae
tttccagaat

SEQ ID NO: 766 - DNA, 10 bp, Saccharomyces cerevisiae
tttccagaat

SEQ ID NO: 767 - DNA, 10 bp, Saccharomyces cerevisiae
tttccagaat

SEQ ID NO: 768 - DNA, 10 bp, Saccharomyces cerevisiae
tttccagaat

SEQ ID NO: 769 - DNA, 10 bp, Saccharomyces cerevisiae
tggacaatgt

SEQ ID NO: 770 - DNA, 10 bp, Saccharomyces cerevisiae
tggacaatgt

SEQ ID NO: 771 - DNA, 10 bp, Saccharomyces cerevisiae
tggacaatgt

SEQ ID NO: 772 - DNA, 10 bp, Saccharomyces cerevisiae
tggacaatgt

SEQ ID NO: 773 - DNA, 10 bp, Saccharomyces cerevisiae
cgatgagaag

SEQ ID NO: 774 - DNA, 10 bp, Saccharomyces cerevisiae
cgatgagaag

SEQ ID NO: 775 - DNA, 10 bp, Saccharomyces cerevisiae
cgatgagaag

SEQ ID NO: 776 - DNA, 10 bp, Saccharomyces cerevisiae
cgatgagaag

SEQ ID NO: 777 - DNA, 10 bp, Saccharomyces cerevisiae
gtacctcatt

SEQ ID NO: 778 - DNA, 10 bp, Saccharomyces cerevisiae
ttcgatatgg

SEQ ID NO: 779 - DNA, 10 bp, Saccharomyces cerevisiae
ttcgatatgg

SEQ ID NO: 780 - DNA, 10 bp, Saccharomyces cerevisiae
ggactgtgta

SEQ ID NO: 781 - DNA, 10 bp, Saccharomyces cerevisiae
ggactgtgta

SEQ ID NO: 782 - DNA, 10 bp, Saccharomyces cerevisiae
agcaggagtt

SEQ ID NO: 783 - DNA, 10 bp, Saccharomyces cerevisiae
agcaggagtt

SEQ ID NO: 784 - DNA, 10 bp, Saccharomyces cerevisiae
agcaggagtt

SEQ ID NO: 785 - DNA, 10 bp, Saccharomyces cerevisiae
agcaggagtt

SEQ ID NO: 786 - DNA, 10 bp, Saccharomyces cerevisiae
aaaccgtccc

SEQ ID NO: 787 - DNA, 10 bp, Saccharomyces cerevisiae
cattggtact

SEQ ID NO: 788 - DNA, 10 bp, Saccharomyces cerevisiae
gacttctttc

SEQ ID NO: 789 - DNA, 10 bp, Saccharomyces cerevisiae
aaattgagat

SEQ ID NO: 790 - DNA, 10 bp, Saccharomyces cerevisiae
atggccgtag

SEQ ID NO: 791 - DNA, 10 bp, Saccharomyces cerevisiae
aattgacgaa

SEQ ID NO: 792 - DNA, 10 bp, Saccharomyces cerevisiae
aattgacgaa

SEQ ID NO: 793 - DNA, 10 bp, Saccharomyces cerevisiae
actatatgtt

SEQ ID NO: 794 - DNA, 10 bp, Saccharomyces cerevisiae
actatatgtt

SEQ ID NO: 795 - DNA, 10 bp, Saccharomyces cerevisiae
ttgatgattt

SEQ ID NO: 796 - DNA, 10 bp, Saccharomyces cerevisiae
actatatgtt

SEQ ID NO: 797 - DNA, 10 bp, Saccharomyces cerevisiae
ttgatgattt

SEQ ID NO: 798 - DNA, 10 bp, Saccharomyces cerevisiae
gatatatcat

SEQ ID NO: 799 - DNA, 10 bp, Saccharomyces cerevisiae
gatatatcat

SEQ ID NO: 800 - DNA, 10 bp, Saccharomyces cerevisiae
gatatatcat

SEQ ID NO: 801 - DNA, 10 bp, Saccharomyces cerevisiae
gatatatcat

SEQ ID NO: 802 - DNA, 10 bp, Saccharomyces cerevisiae
tccgaatatg

SEQ ID NO: 803 - DNA, 10 bp, Saccharomyces cerevisiae
aagttgaaca

SEQ ID NO: 804 - DNA, 10 bp, Saccharomyces cerevisiae
aagttgaaca

SEQ ID NO: 805 - DNA, 10 bp, Saccharomyces cerevisiae
aacttagttt

SEQ ID NO: 806 - DNA, 10 bp, Saccharomyces cerevisiae
atgtgtgatt

SEQ ID NO: 807 - DNA, 10 bp, Saccharomyces cerevisiae
agaattgatt

SEQ ID NO: 808 - DNA, 10 bp, Saccharomyces cerevisiae
ccaatggttc

SEQ ID NO: 809 - DNA, 10 bp, Saccharomyces cerevisiae
ggatattacc

SEQ ID NO: 810 - DNA, 10 bp, Saccharomyces cerevisiae
ggatattacc

SEQ ID NO: 811 - DNA, 10 bp, Saccharomyces cerevisiae
tgacattctt

SEQ ID NO: 812 - DNA, 10 bp, Saccharomyces cerevisiae
ggtgttaacg

SEQ ID NO: 813 - DNA, 10 bp, Saccharomyces cerevisiae
agacaaactg

SEQ ID NO: 814 - DNA, 10 bp, Saccharomyces cerevisiae
taccactcct

SEQ ID NO: 815 - DNA, 10 bp, Saccharomyces cerevisiae
ggtttcggtt

SEQ ID NO: 816 - DNA, 10 bp, Saccharomyces cerevisiae
ttgccagtct

SEQ ID NO: 817 - DNA, 10 bp, Saccharomyces cerevisiae
ggtgaaaacg

SEQ ID NO: 818 - DNA, 10 bp, Saccharomyces cerevisiae
atcgccgctc

SEQ ID NO: 819 - DNA, 10 bp, Saccharomyces cerevisiae
ggtgctaaga

SEQ ID NO: 820 - DNA, 10 bp, Saccharomyces cerevisiae
ttagtttcta

SEQ ID NO: 821 - DNA, 10 bp, Saccharomyces cerevisiae
tctctactgg

SEQ ID NO: 822 - DNA, 10 bp, Saccharomyces cerevisiae
ggttttggtt

SEQ ID NO: 823 - DNA, 10 bp, Saccharomyces cerevisiae
ggtccagctt

SEQ ID NO: 824 - DNA, 10 bp, Saccharomyces cerevisiae
aatccagttg

SEQ ID NO: 825 - DNA, 10 bp, Saccharomyces cerevisiae
ttcgttcact

SEQ ID NO: 826 - DNA, 10 bp, Saccharomyces cerevisiae
aacagaccag

SEQ ID NO: 827 - DNA, 10 bp, Saccharomyces cerevisiae
ctgctctggg

SEQ ID NO: 828 - DNA, 10 bp, Saccharomyces cerevisiae
gcaatactac

SEQ ID NO: 829 - DNA, 10 bp, Saccharomyces cerevisiae
gctctccccc

SEQ ID NO: 830 - DNA, 10 bp, Saccharomyces cerevisiae
aaagacagag

SEQ ID NO: 831 - DNA, 10 bp, Saccharomyces cerevisiae
tgtcgtggtg

SEQ ID NO: 832 - DNA, 10 bp, Saccharomyces cerevisiae
ccaagggtat

SEQ ID NO: 833 - DNA, 10 bp, Saccharomyces cerevisiae
tctccagaag

SEQ ID NO: 834 - DNA, 10 bp, Saccharomyces cerevisiae
gtttttcttt

SEQ ID NO: 835 - DNA, 10 bp, Saccharomyces cerevisiae
atcactggtg

SEQ ID NO: 836 - DNA, 10 bp, Saccharomyces cerevisiae
atgaaggttc

SEQ ID NO: 837 - DNA, 10 bp, Saccharomyces cerevisiae
gtagagccgg

SEQ ID NO: 838 - DNA, 10 bp, Saccharomyces cerevisiae
ggtactgatg

SEQ ID NO: 839 - DNA, 10 bp, Saccharomyces cerevisiae
ccagatttgt

SEQ ID NO: 840 - DNA, 10 bp, Saccharomyces cerevisiae
gctgctcaaa

SEQ ID NO: 841 - DNA, 10 bp, Saccharomyces cerevisiae
gtgccgtcca

SEQ ID NO: 842 - DNA, 10 bp, Saccharomyces cerevisiae
caaaacccaa

SEQ ID NO: 843 - DNA, 10 bp, Saccharomyces cerevisiae
ccatctttac

SEQ ID NO: 844 - DNA, 10 bp, Saccharomyces cerevisiae
ttgaactacc

SEQ ID NO: 845 - DNA, 10 bp, Saccharomyces cerevisiae
aacatcaagc

SEQ ID NO: 846 - DNA, 10 bp, Saccharomyces cerevisiae
gaacacttct

SEQ ID NO: 847 - DNA, 10 bp, Saccharomyces cerevisiae
ttcgggtcac

SEQ ID NO: 848 - DNA, 10 bp, Saccharomyces cerevisiae
tcgtctgttt

SEQ ID NO: 849 - DNA, 10 bp, Saccharomyces cerevisiae
acatctcata

SEQ ID NO: 850 - DNA, 10 bp, Saccharomyces cerevisiae
gtcagattgg

SEQ ID NO: 851 - DNA, 10 bp, Saccharomyces cerevisiae
aaggtcaaga

SEQ ID NO: 852 - DNA, 10 bp, Saccharomyces cerevisiae
taactggact

SEQ ID NO: 853 - DNA, 10 bp, Saccharomyces cerevisiae
tcttgagaat

SEQ ID NO: 854 - DNA, 10 bp, Saccharomyces cerevisiae
ctctactgtc

SEQ ID NO: 855 - DNA, 10 bp, Saccharomyces cerevisiae
ctcaatccaa

SEQ ID NO: 856 - DNA, 10 bp, Saccharomyces cerevisiae
tcttctcgtt

SEQ ID NO: 857 - DNA, 10 bp, Saccharomyces cerevisiae
ttgtctttgg

SEQ ID NO: 858 - DNA, 10 bp, Saccharomyces cerevisiae
ccacggttct

SEQ ID NO: 859 - DNA, 10 bp, Saccharomyces cerevisiae
ccagatatga

SEQ ID NO: 860 - DNA, 10 bp, Saccharomyces cerevisiae
gtttcaacgg

SEQ ID NO: 861 - DNA, 10 bp, Saccharomyces cerevisiae
gacgtcatca

SEQ ID NO: 862 - DNA, 10 bp, Saccharomyces cerevisiae
acaagatctt

SEQ ID NO: 863 - DNA, 10 bp, Saccharomyces cerevisiae
gataaatacc

SEQ ID NO: 864 - DNA, 10 bp, Saccharomyces cerevisiae
gttatggcca

SEQ ID NO: 865 - DNA, 10 bp, Saccharomyces cerevisiae
acatcattga

SEQ ID NO: 866 - DNA, 10 bp, Saccharomyces cerevisiae
ttcaaaagaa

SEQ ID NO: 867 - DNA, 10 bp, Saccharomyces cerevisiae
tttaaaatgg

SEQ ID NO: 868 - DNA, 10 bp, Saccharomyces cerevisiae
agaaagcaag

SEQ ID NO: 869 - DNA, 10 bp, Saccharomyces cerevisiae
agaatcttga

SEQ ID NO: 870 - DNA, 10 bp, Saccharomyces cerevisiae
atctttaatt

SEQ ID NO: 871 - DNA, 10 bp, Saccharomyces cerevisiae
agaccattgc

SEQ ID NO: 872 - DNA, 10 bp, Saccharomyces cerevisiae
gctgctagac

SEQ ID NO: 873 - DNA, 10 bp, Saccharomyces cerevisiae
gaagaattag

SEQ ID NO: 874 - DNA, 10 bp, Saccharomyces cerevisiae
ctggcaaacc

SEQ ID NO: 875 - DNA, 10 bp, Saccharomyces cerevisiae
caacaactac

SEQ ID NO: 876 - DNA, 10 bp, Saccharomyces cerevisiae
ggtgtcgttg

SEQ ID NO: 877 - DNA, 10 bp, Saccharomyces cerevisiae
tacttcaact

SEQ ID NO: 878 - DNA, 10 bp, Saccharomyces cerevisiae
cacaccaaga

SEQ ID NO: 879 - DNA, 10 bp, Saccharomyces cerevisiae
gcaaagacct

SEQ ID NO: 880 - DNA, 10 bp, Saccharomyces cerevisiae
aactaaactg

SEQ ID NO: 881 - DNA, 10 bp, Saccharomyces cerevisiae
ggtaacgtaa

SEQ ID NO: 882 - DNA, 10 bp, Saccharomyces cerevisiae
aaggacagag

SEQ ID NO: 883 - DNA, 10 bp, Saccharomyces cerevisiae
accccagctc

SEQ ID NO: 884 - DNA, 10 bp, Saccharomyces cerevisiae
tactcttcgc

SEQ ID NO: 885 - DNA, 10 bp, Saccharomyces cerevisiae
tcgcttcatt

SEQ ID NO: 886 - DNA, 10 bp, Saccharomyces cerevisiae
aaatgaattt

SEQ ID NO: 887 - DNA, 10 bp, Saccharomyces cerevisiae
ggtactgaag

SEQ ID NO: 888 - DNA, 10 bp, Saccharomyces cerevisiae
tccgagtccg

SEQ ID NO: 889 - DNA, 10 bp, Saccharomyces cerevisiae
tacacaattt

SEQ ID NO: 890 - DNA, 10 bp, Saccharomyces cerevisiae
tattgtactt

SEQ ID NO: 891 - DNA, 10 bp, Saccharomyces cerevisiae
tctaagtccg

SEQ ID NO: 892 - DNA, 10 bp, Saccharomyces cerevisiae
ggatgatgaa

SEQ ID NO: 893 - DNA, 10 bp, Saccharomyces cerevisiae
gatgtcatca

SEQ ID NO: 894 - DNA, 10 bp, Saccharomyces cerevisiae
tgggcttggg

SEQ ID NO: 895 - DNA, 10 bp, Saccharomyces cerevisiae
aacgctttaa

SEQ ID NO: 896 - DNA, 10 bp, Saccharomyces cerevisiae
tacaatttta

SEQ ID NO: 897 - DNA, 10 bp, Saccharomyces cerevisiae
acgttctttt

SEQ ID NO: 898 - DNA, 10 bp, Saccharomyces cerevisiae
tttctcaagt

SEQ ID NO: 899 - DNA, 10 bp, Saccharomyces cerevisiae
ggtactttga

SEQ ID NO: 900 - DNA, 10 bp, Saccharomyces cerevisiae
ttgaaatttt

SEQ ID NO: 901 - DNA, 10 bp, Saccharomyces cerevisiae
aagaagccag

SEQ ID NO: 902 - DNA, 10 bp, Saccharomyces cerevisiae
gctgctatgc

SEQ ID NO: 903 - DNA, 10 bp, Saccharomyces cerevisiae
tttaccagtt

SEQ ID NO: 904 - DNA, 10 bp, Saccharomyces cerevisiae
aaggaattca

SEQ ID NO: 905 - DNA, 10 bp, Saccharomyces cerevisiae
ctgtctctga

SEQ ID NO: 906 - DNA, 10 bp, Saccharomyces cerevisiae
ttgggtagtg

SEQ ID NO: 907 - DNA, 10 bp, Saccharomyces cerevisiae
tgtaattaaa

SEQ ID NO: 908 - DNA, 10 bp, Saccharomyces cerevisiae
tttcccaagt

SEQ ID NO: 909 - DNA, 10 bp, Saccharomyces cerevisiae
gaaaacatct

SEQ ID NO: 910 - DNA, 10 bp, Saccharomyces cerevisiae
ccattctggg

SEQ ID NO: 911 - DNA, 10 bp, Saccharomyces cerevisiae
gaatactaag

SEQ ID NO: 912 - DNA, 10 bp, Saccharomyces cerevisiae
agaagagcta

SEQ ID NO: 913 - DNA, 10 bp, Saccharomyces cerevisiae
gctttaagtt

SEQ ID NO: 914 - DNA, 10 bp, Saccharomyces cerevisiae
ggagatcttg

SEQ ID NO: 915 - DNA, 10 bp, Saccharomyces cerevisiae
gttttcccaa

SEQ ID NO: 916 - DNA, 10 bp, Saccharomyces cerevisiae
cacgaaaagc

SEQ ID NO: 917 - DNA, 10 bp, Saccharomyces cerevisiae
tgtctcagcg

SEQ ID NO: 918 - DNA, 10 bp, Saccharomyces cerevisiae
tctagtctct

SEQ ID NO: 919 - DNA, 10 bp, Saccharomyces cerevisiae
gctgccagac

SEQ ID NO: 920 - DNA, 10 bp, Saccharomyces cerevisiae
ttagaaaggt

SEQ ID NO: 921 - DNA, 10 bp, Saccharomyces cerevisiae
aaaaaaaaaa

SEQ ID NO: 922 - DNA, 10 bp, Saccharomyces cerevisiae
gtgccgccat

SEQ ID NO: 923 - DNA, 10 bp, Saccharomyces cerevisiae
cctgtttgag

SEQ ID NO: 924 - DNA, 10 bp, Saccharomyces cerevisiae
ttgtctcttt

SEQ ID NO: 925 - DNA, 10 bp, Saccharomyces cerevisiae
atttcttgag

SEQ ID NO: 926 - DNA, 10 bp, Saccharomyces cerevisiae
atctccaatg

SEQ ID NO: 927 - DNA, 10 bp, Saccharomyces cerevisiae
agaaaacaag

SEQ ID NO: 928 - DNA, 10 bp, Saccharomyces cerevisiae
aattattaag

SEQ ID NO: 929 - DNA, 10 bp, Saccharomyces cerevisiae
atttaatatc

SEQ ID NO: 930 - DNA, 10 bp, Saccharomyces cerevisiae
tcaagaagtt

SEQ ID NO: 931 - DNA, 10 bp, Saccharomyces cerevisiae
accgccactc

SEQ ID NO: 932 - DNA, 10 bp, Saccharomyces cerevisiae
ggacctgccg

SEQ ID NO: 933 - DNA, 10 bp, Saccharomyces cerevisiae
acttttaaat

SEQ ID NO: 934 - DNA, 10 bp, Saccharomyces cerevisiae
gttgttttca

SEQ ID NO: 935 - DNA, 10 bp, Saccharomyces cerevisiae
tttatataaa

SEQ ID NO: 936 - DNA, 10 bp, Saccharomyces cerevisiae
cacttcaaca

SEQ ID NO: 937 - DNA, 10 bp, Saccharomyces cerevisiae
aaaaactttg

SEQ ID NO: 938 - DNA, 10 bp, Saccharomyces cerevisiae
aactgtgctg

SEQ ID NO: 939 - DNA, 10 bp, Saccharomyces cerevisiae
gaaatctggt

SEQ ID NO: 940 - DNA, 10 bp, Saccharomyces cerevisiae
gaggacgcca

SEQ ID NO: 941 - DNA, 10 bp, Saccharomyces cerevisiae
ttttgtacaa

SEQ ID NO: 942 - DNA, 10 bp, Saccharomyces cerevisiae
aagttgaaca

SEQ ID NO: 943 - DNA, 10 bp, Saccharomyces cerevisiae
ccaatgcaca

SEQ ID NO: 944 - DNA, 10 bp, Saccharomyces cerevisiae
aggaagctag

SEQ ID NO: 945 - DNA, 10 bp, Saccharomyces cerevisiae
tgtacgcatt

SEQ ID NO: 946 - DNA, 10 bp, Saccharomyces cerevisiae
tcgacgtggc

SEQ ID NO: 947 - DNA, 10 bp, Saccharomyces cerevisiae
gggtgcgggt

SEQ ID NO: 948 - DNA, 10 bp, Saccharomyces cerevisiae
gtcgttccta

SEQ ID NO: 949 - DNA, 10 bp, Saccharomyces cerevisiae
cggtagtcca

SEQ ID NO: 950 - DNA, 10 bp, Saccharomyces cerevisiae
ggatggatgc

SEQ ID NO: 951 - DNA, 10 bp, Saccharomyces cerevisiae
actagaattt

SEQ ID NO: 952 - DNA, 10 bp, Saccharomyces cerevisiae
accaatctac

SEQ ID NO: 953 - DNA, 10 bp, Saccharomyces cerevisiae
ggagatttca

SEQ ID NO: 954 - DNA, 10 bp, Saccharomyces cerevisiae
ttttattatc

SEQ ID NO: 955 - DNA, 10 bp, Saccharomyces cerevisiae
ctagaacgcg

SEQ ID NO: 956 - DNA, 10 bp, Saccharomyces cerevisiae
aagctaccgt

SEQ ID NO: 957 - DNA, 10 bp, Saccharomyces cerevisiae
tgactctttg

SEQ ID NO: 958 - DNA, 10 bp, Saccharomyces cerevisiae
attacgtttt

SEQ ID NO: 959 - DNA, 10 bp, Saccharomyces cerevisiae
tcccgtacat

SEQ ID NO: 960 - DNA, 10 bp, Saccharomyces cerevisiae
agtgtgcgta

SEQ ID NO: 961 - DNA, 10 bp, Saccharomyces cerevisiae
cacagaaaaa

SEQ ID NO: 962 - DNA, 10 bp, Saccharomyces cerevisiae
ggttttaagt

SEQ ID NO: 963 - DNA, 10 bp, Saccharomyces cerevisiae
acttaataat

SEQ ID NO: 964 - DNA, 10 bp, Saccharomyces cerevisiae
gtttatccaa

SEQ ID NO: 965 - DNA, 10 bp, Saccharomyces cerevisiae
tacttactca

SEQ ID NO: 966 - DNA, 10 bp, Saccharomyces cerevisiae
tttggtggta

SEQ ID NO: 967 - DNA, 10 bp, Saccharomyces cerevisiae
ctcaaaccga

SEQ ID NO: 968 - DNA, 10 bp, Saccharomyces cerevisiae
ggagaaggtg

SEQ ID NO: 969 - DNA, 10 bp, Saccharomyces cerevisiae
ttactttcac

SEQ ID NO: 970 - DNA, 10 bp, Saccharomyces cerevisiae
atgctgaggg

SEQ ID NO: 971 - DNA, 10 bp, Saccharomyces cerevisiae
gtgtggtcac

SEQ ID NO: 972 - DNA, 10 bp, Saccharomyces cerevisiae
cttctctttt

SEQ ID NO: 973 - DNA, 10 bp, Saccharomyces cerevisiae
tggtgaagtc

SEQ ID NO: 974 - DNA, 10 bp, Saccharomyces cerevisiae
cacttgagtt

SEQ ID NO: 975 - DNA, 10 bp, Saccharomyces cerevisiae
tgagggtgat

SEQ ID NO: 976 - DNA, 10 bp, Saccharomyces cerevisiae
tgatactaag

SEQ ID NO: 977 - DNA, 10 bp, Saccharomyces cerevisiae
ttggaaagga

SEQ ID NO: 978 - DNA, 10 bp, Saccharomyces cerevisiae
ttccactatt

SEQ ID NO: 979 - DNA, 10 bp, Saccharomyces cerevisiae
cacttcaact

SEQ ID NO: 980 - DNA, 10 bp, Saccharomyces cerevisiae
cagaccgctt

SEQ ID NO: 981 - DNA, 10 bp, Saccharomyces cerevisiae
ggtcaatggc

SEQ ID NO: 982 - DNA, 10 bp, Saccharomyces cerevisiae
taagaattct

SEQ ID NO: 983 - DNA, 10 bp, Saccharomyces cerevisiae
tcgaagctgt

SEQ ID NO: 984 - DNA, 10 bp, Saccharomyces cerevisiae
gccaagcaat

SEQ ID NO: 985 - DNA, 10 bp, Saccharomyces cerevisiae
tatgaatgca

SEQ ID NO: 986 - DNA, 10 bp, Saccharomyces cerevisiae
tcaattatgt

SEQ ID NO: 987 - DNA, 10 bp, Saccharomyces cerevisiae
tttcctataa

SEQ ID NO: 988 - DNA, 10 bp, Saccharomyces cerevisiae
aacgatcttc

SEQ ID NO: 989 - DNA, 10 bp, Saccharomyces cerevisiae
acggccaaga

SEQ ID NO: 990 - DNA, 10 bp, Saccharomyces cerevisiae
tctagtcgcc

SEQ ID NO: 991 - DNA, 10 bp, Saccharomyces cerevisiae
actgaaaacg

SEQ ID NO: 992 - DNA, 10 bp, Saccharomyces cerevisiae
atccatcgtg

SEQ ID NO: 993 - DNA, 10 bp, Saccharomyces cerevisiae
attccgttga

SEQ ID NO: 994 - DNA, 10 bp, Saccharomyces cerevisiae
ttggccccac

SEQ ID NO: 995 - DNA, 10 bp, Saccharomyces cerevisiae
aaattgatgc

SEQ ID NO: 996 - DNA, 10 bp, Saccharomyces cerevisiae
acttatgtaa

SEQ ID NO: 997 - DNA, 10 bp, Saccharomyces cerevisiae
ccttccaggt

SEQ ID NO: 998 - DNA, 10 bp, Saccharomyces cerevisiae
tctatatgtg

SEQ ID NO: 999 - DNA, 10 bp, Saccharomyces cerevisiae
ttgggctagt

SEQ ID NO: 1000 - DNA, 10 bp, Saccharomyces cerevisiae
tttgttcgta

SEQ ID NO: 1001 - DNA, 10 bp, Saccharomyces cerevisiae
caaatttttg

SEQ ID NO: 1002 - DNA, 10 bp, Saccharomyces cerevisiae
cctctcttgt

SEQ ID NO: 1003 - DNA, 10 bp, Saccharomyces cerevisiae
cggaccttgt

SEQ ID NO: 1004 - DNA, 10 bp, Saccharomyces cerevisiae
gcaattggtc

SEQ ID NO: 1005 - DNA, 10 bp, Saccharomyces cerevisiae
ggcaaacgaa

SEQ ID NO: 1006 - DNA, 10 bp, Saccharomyces cerevisiae
gactagcgaa

SEQ ID NO: 1007 - DNA, 10 bp, Saccharomyces cerevisiae
ttgatccgtg

SEQ ID NO: 1008 - DNA, 10 bp, Saccharomyces cerevisiae
aacaagtact

SEQ ID NO: 1009 - DNA, 10 bp, Saccharomyces cerevisiae
atggcttctc

SEQ ID NO: 1010 - DNA, 10 bp, Saccharomyces cerevisiae
cccaaaactt

SEQ ID NO: 1011 - DNA, 10 bp, Saccharomyces cerevisiae
gccgcttaca

SEQ ID NO: 1012 - DNA, 10 bp, Saccharomyces cerevisiae
tatagaatta

SEQ ID NO: 1013 - DNA, 10 bp, Saccharomyces cerevisiae
tgattttgtt

SEQ ID NO: 1014 - DNA, 10 bp, Saccharomyces cerevisiae
aattcaacag

SEQ ID NO: 1015 - DNA, 10 bp, Saccharomyces cerevisiae
agaagcggtt

SEQ ID NO: 1016 - DNA, 10 bp, Saccharomyces cerevisiae
tctaaattgt

SEQ ID NO: 1017 - DNA, 10 bp, Saccharomyces cerevisiae
gcgaattcga

SEQ ID NO: 1018 - DNA, 10 bp, Saccharomyces cerevisiae
ggaatctact

SEQ ID NO: 1019 - DNA, 10 bp, Saccharomyces cerevisiae
ttaaaaaaaa

SEQ ID NO: 1020 - DNA, 10 bp, Saccharomyces cerevisiae
aaaccttcac

SEQ ID NO: 1021 - DNA, 10 bp, Saccharomyces cerevisiae
aacaataaaa

SEQ ID NO: 1022 - DNA, 10 bp, Saccharomyces cerevisiae
atcgttttat

SEQ ID NO: 1023 - DNA, 10 bp, Saccharomyces cerevisiae
caaaagaccg

SEQ ID NO: 1024 - DNA, 10 bp, Saccharomyces cerevisiae
ggtttttgat

SEQ ID NO: 1025 - DNA, 10 bp, Saccharomyces cerevisiae
tcgtcgtcag

SEQ ID NO: 1026 - DNA, 10 bp, Saccharomyces cerevisiae
ttagccactg

SEQ ID NO: 1027 - DNA, 10 bp, Saccharomyces cerevisiae
ttttggaaca

SEQ ID NO: 1028 - DNA, 10 bp, Saccharomyces cerevisiae
caatccattt

SEQ ID NO: 1029 - DNA, 10 bp, Saccharomyces cerevisiae
ctggtgctaa

SEQ ID NO: 1030 - DNA, 10 bp, Saccharomyces cerevisiae
gctagacaaa

SEQ ID NO: 1031 - DNA, 10 bp, Saccharomyces cerevisiae
ttttgggtct

SEQ ID NO: 1032 - DNA, 10 bp, Saccharomyces cerevisiae
aacaggccgc

SEQ ID NO: 1033 - DNA, 10 bp, Saccharomyces cerevisiae
aactgtccat

SEQ ID NO: 1034 - DNA, 10 bp, Saccharomyces cerevisiae
ccaaggttaa

SEQ ID NO: 1035 - DNA, 10 bp, Saccharomyces cerevisiae
cggtacagaa

SEQ ID NO: 1036 - DNA, 10 bp, Saccharomyces cerevisiae
gaaagagatt

SEQ ID NO: 1037 - DNA, 10 bp, Saccharomyces cerevisiae
ggccaatggt

SEQ ID NO: 1038 - DNA, 10 bp, Saccharomyces cerevisiae
ggtttttgaa

SEQ ID NO: 1039 - DNA, 10 bp, Saccharomyces cerevisiae
gtttttccca

SEQ ID NO: 1040 - DNA, 10 bp, Saccharomyces cerevisiae
tggtttaacg

SEQ ID NO: 1041 - DNA, 10 bp, Saccharomyces cerevisiae
aagatgctat

SEQ ID NO: 1042 - DNA, 10 bp, Saccharomyces cerevisiae
ctaaacgcgc

SEQ ID NO: 1043 - DNA, 10 bp, Saccharomyces cerevisiae
gaactttata

SEQ ID NO: 1044 - DNA, 10 bp, Saccharomyces cerevisiae
gggtgatgct

SEQ ID NO: 1045 - DNA, 10 bp, Saccharomyces cerevisiae
ttcttgaccg

SEQ ID NO: 1046 - DNA, 10 bp, Saccharomyces cerevisiae
accctgtcat

SEQ ID NO: 1047 - DNA, 10 bp, Saccharomyces cerevisiae
atatcattga

SEQ ID NO: 1048 - DNA, 10 bp, Saccharomyces cerevisiae
ccaccaaagg

SEQ ID NO: 1049 - DNA, 10 bp, Saccharomyces cerevisiae
ccccgtacat

SEQ ID NO: 1050 - DNA, 10 bp, Saccharomyces cerevisiae
ctgcgttaca

SEQ ID NO: 1051 - DNA, 10 bp, Saccharomyces cerevisiae
cttactttga

SEQ ID NO: 1052 - DNA, 10 bp, Saccharomyces cerevisiae
tattttcatt

SEQ ID NO: 1053 - DNA, 10 bp, Saccharomyces cerevisiae
ttccctcact

SEQ ID NO: 1054 - DNA, 10 bp, Saccharomyces cerevisiae
actgctgact

SEQ ID NO: 1055 - DNA, 10 bp, Saccharomyces cerevisiae
agagtgcata

SEQ ID NO: 1056 - DNA, 10 bp, Saccharomyces cerevisiae
atctttggct

SEQ ID NO: 1057 - DNA, 10 bp, Saccharomyces cerevisiae
cacggtttgc

SEQ ID NO: 1058 - DNA, 10 bp, Saccharomyces cerevisiae
tctttgatta

SEQ ID NO: 1059 - DNA, 10 bp, Saccharomyces cerevisiae
tgtgtttttg

SEQ ID NO: 1060 - DNA, 10 bp, Saccharomyces cerevisiae
tttacgccct

SEQ ID NO: 1061 - DNA, 10 bp, Saccharomyces cerevisiae
attaccgttt

SEQ ID NO: 1062 - DNA, 10 bp, Saccharomyces cerevisiae
attggtcaat

SEQ ID NO: 1063 - DNA, 10 bp, Saccharomyces cerevisiae
cgagctttcg

SEQ ID NO: 1064 - DNA, 10 bp, Saccharomyces cerevisiae
cgtaaatact

SEQ ID NO: 1065 - DNA, 10 bp, Saccharomyces cerevisiae
gcaaaaatat

SEQ ID NO: 1066 - DNA, 10 bp, Saccharomyces cerevisiae
gcttgggcgg

SEQ ID NO: 1067 - DNA, 10 bp, Saccharomyces cerevisiae
ggggtgataa

SEQ ID NO: 1068 - DNA, 10 bp, Saccharomyces cerevisiae
gtgaagattg

SEQ ID NO: 1069 - DNA, 10 bp, Saccharomyces cerevisiae
taaggagttt

SEQ ID NO: 1070 - DNA, 10 bp, Saccharomyces cerevisiae
ttaattctgt

SEQ ID NO: 1071 - DNA, 10 bp, Saccharomyces cerevisiae
aaaagatcat

SEQ ID NO: 1072 - DNA, 10 bp, Saccharomyces cerevisiae
aacaagtcgg

SEQ ID NO: 1073 - DNA, 10 bp, Saccharomyces cerevisiae
aactgaatct

SEQ ID NO: 1074 - DNA, 10 bp, Saccharomyces cerevisiae
aagacaatcg

SEQ ID NO: 1075 - DNA, 10 bp, Saccharomyces cerevisiae
aaggagttgg

SEQ ID NO: 1076 - DNA, 10 bp, Saccharomyces cerevisiae
cgaacgatga

SEQ ID NO: 1077 - DNA, 10 bp, Saccharomyces cerevisiae
gcaacaactt

SEQ ID NO: 1078 - DNA, 10 bp, Saccharomyces cerevisiae
ggatataaat

SEQ ID NO: 1079 - DNA, 10 bp, Saccharomyces cerevisiae
ggtccaatta

SEQ ID NO: 1080 - DNA, 10 bp, Saccharomyces cerevisiae
ggtccattgg

SEQ ID NO: 1081 - DNA, 10 bp, Saccharomyces cerevisiae
ggtgctgtta

SEQ ID NO: 1082 - DNA, 10 bp, Saccharomyces cerevisiae
gtggtctctc

SEQ ID NO: 1083 - DNA, 10 bp, Saccharomyces cerevisiae
atattcttcc

SEQ ID NO: 1084 - DNA, 10 bp, Saccharomyces cerevisiae
atgtttttga

SEQ ID NO: 1085 - DNA, 10 bp, Saccharomyces cerevisiae
cctggtcgtc

SEQ ID NO: 1086 - DNA, 10 bp, Saccharomyces cerevisiae
gactaatgtt

SEQ ID NO: 1087 - DNA, 10 bp, Saccharomyces cerevisiae
gaggataacg

SEQ ID NO: 1088 - DNA, 10 bp, Saccharomyces cerevisiae
gcagtaaagg

SEQ ID NO: 1089 - DNA, 10 bp, Saccharomyces cerevisiae
gccttgtgct

SEQ ID NO: 1090 - DNA, 10 bp, Saccharomyces cerevisiae
gcgcaccaaa

SEQ ID NO: 1091 - DNA, 10 bp, Saccharomyces cerevisiae
gtacaccaca

SEQ ID NO: 1092 - DNA, 10 bp, Saccharomyces cerevisiae
aaggagtctc

SEQ ID NO: 1093 - DNA, 10 bp, Saccharomyces cerevisiae
aggacgttga

SEQ ID NO: 1094 - DNA, 10 bp, Saccharomyces cerevisiae
cagaaaatgg

SEQ ID NO: 1095 - DNA, 10 bp, Saccharomyces cerevisiae
ccattcattt

SEQ ID NO: 1096 - DNA, 10 bp, Saccharomyces cerevisiae
cggtctctat

SEQ ID NO: 1097 - DNA, 10 bp, Saccharomyces cerevisiae
ctttcttcag

SEQ ID NO: 1098 - DNA, 10 bp, Saccharomyces cerevisiae
gacgacttgg

SEQ ID NO: 1099 - DNA, 10 bp, Saccharomyces cerevisiae
gctgctactt

SEQ ID NO: 1100 - DNA, 10 bp, Saccharomyces cerevisiae
ggcaaattac

SEQ ID NO: 1101 - DNA, 10 bp, Saccharomyces cerevisiae
gttgcataat

SEQ ID NO: 1102 - DNA, 10 bp, Saccharomyces cerevisiae
tggtgttgtc

SEQ ID NO: 1103 - DNA, 10 bp, Saccharomyces cerevisiae
ttcttcgcct

SEQ ID NO: 1104 - DNA, 10 bp, Saccharomyces cerevisiae
agaaaaaatc

SEQ ID NO: 1105 - DNA, 10 bp, Saccharomyces cerevisiae
agcgggttct

SEQ ID NO: 1106 - DNA, 10 bp, Saccharomyces cerevisiae
cgttcatccg

SEQ ID NO: 1107 - DNA, 10 bp, Saccharomyces cerevisiae
cttaaaatct

SEQ ID NO: 1108 - DNA, 10 bp, Saccharomyces cerevisiae
gagttgctga

SEQ ID NO: 1109 - DNA, 10 bp, Saccharomyces cerevisiae
gggcgaggct

SEQ ID NO: 1110 - DNA, 10 bp, Saccharomyces cerevisiae
ggtaagaaaa

SEQ ID NO: 1111 - DNA, 10 bp, Saccharomyces cerevisiae
ggtactagaa

SEQ ID NO: 1112 - DNA, 10 bp, Saccharomyces cerevisiae
gttccaagac

SEQ ID NO: 1113 - DNA, 10 bp, Saccharomyces cerevisiae
tgacattctt

SEQ ID NO: 1114 - DNA, 10 bp, Saccharomyces cerevisiae
tgcgcctctt

SEQ ID NO: 1115 - DNA, 10 bp, Saccharomyces cerevisiae
ttgacaaatt

SEQ ID NO: 1116 - DNA, 10 bp, Saccharomyces cerevisiae
caggaagctg

SEQ ID NO: 1117 - DNA, 10 bp, Saccharomyces cerevisiae
ccgaacggtt

SEQ ID NO: 1118 - DNA, 10 bp, Saccharomyces cerevisiae
ccgacaacga

SEQ ID NO: 1119 - DNA, 10 bp, Saccharomyces cerevisiae
cgccggttcc

SEQ ID NO: 1120 - DNA, 10 bp, Saccharomyces cerevisiae
gaagtcgctg

SEQ ID NO: 1121 - DNA, 10 bp, Saccharomyces cerevisiae
gcattcaaac

SEQ ID NO: 1122 - DNA, 10 bp, Saccharomyces cerevisiae
gctaaatttt

SEQ ID NO: 1123 - DNA, 10 bp, Saccharomyces cerevisiae
gctttgattg

SEQ ID NO: 1124 - DNA, 10 bp, Saccharomyces cerevisiae
gtcgccagtg

SEQ ID NO: 1125 - DNA, 10 bp, Saccharomyces cerevisiae
tagacatcta

SEQ ID NO: 1126 - DNA, 10 bp, Saccharomyces cerevisiae
ttcaacccaa

SEQ ID NO: 1127 - DNA, 10 bp, Saccharomyces cerevisiae
ttttctatga

SEQ ID NO: 1128 - DNA, 10 bp, Saccharomyces cerevisiae
aaccgctaag

SEQ ID NO: 1129 - DNA, 10 bp, Saccharomyces cerevisiae
aatgtggctc

SEQ ID NO: 1130 - DNA, 10 bp, Saccharomyces cerevisiae
agactccatt

SEQ ID NO: 1131 - DNA, 10 bp, Saccharomyces cerevisiae
atctttagtt

SEQ ID NO: 1132 - DNA, 10 bp, Saccharomyces cerevisiae
atgaccagcc

SEQ ID NO: 1133 - DNA, 10 bp, Saccharomyces cerevisiae
caacccactg

SEQ ID NO: 1134 - DNA, 10 bp, Saccharomyces cerevisiae
cacgccgctc

SEQ ID NO: 1135 - DNA, 10 bp, Saccharomyces cerevisiae
ccgagccaaa

SEQ ID NO: 1136 - DNA, 10 bp, Saccharomyces cerevisiae
cctctacatt

SEQ ID NO: 1137 - DNA, 10 bp, Saccharomyces cerevisiae
ctctaaaccg

SEQ ID NO: 1138 - DNA, 10 bp, Saccharomyces cerevisiae
ctgaccaaat

SEQ ID NO: 1139 - DNA, 10 bp, Saccharomyces cerevisiae
ctttctttta

SEQ ID NO: 1140 - DNA, 10 bp, Saccharomyces cerevisiae
gaaatctgga

SEQ ID NO: 1141 - DNA, 10 bp, Saccharomyces cerevisiae
gatgccgaaa

SEQ ID NO: 1142 - DNA, 10 bp, Saccharomyces cerevisiae
taaaatgatt

SEQ ID NO: 1143 - DNA, 10 bp, Saccharomyces cerevisiae
tactatatat

SEQ ID NO: 1144 - DNA, 10 bp, Saccharomyces cerevisiae
tgattaaaaa

SEQ ID NO: 1145 - DNA, 10 bp, Saccharomyces cerevisiae
tgccctggcc

SEQ ID NO: 1146 - DNA, 10 bp, Saccharomyces cerevisiae
ttgccgaatc

SEQ ID NO: 1147 - DNA, 10 bp, Saccharomyces cerevisiae
acaatgctat

SEQ ID NO: 1148 - DNA, 10 bp, Saccharomyces cerevisiae
agcaaaagtg

SEQ ID NO: 1149 - DNA, 10 bp, Saccharomyces cerevisiae
atattatttg

SEQ ID NO: 1150 - DNA, 10 bp, Saccharomyces cerevisiae
atctttttac

SEQ ID NO: 1151 - DNA, 10 bp, Saccharomyces cerevisiae
ccatttttgg

SEQ ID NO: 1152 - DNA, 10 bp, Saccharomyces cerevisiae
ctatatttca

SEQ ID NO: 1153 - DNA, 10 bp, Saccharomyces cerevisiae
gacatttgtt

SEQ ID NO: 1154 - DNA, 10 bp, Saccharomyces cerevisiae
ggaagaagct

SEQ ID NO: 1155 - DNA, 10 bp, Saccharomyces cerevisiae
gtcccaaaaa

SEQ ID NO: 1156 - DNA, 10 bp, Saccharomyces cerevisiae
gttactcggg

SEQ ID NO: 1157 - DNA, 10 bp, Saccharomyces cerevisiae
taacgagtac

SEQ ID NO: 1158 - DNA, 10 bp, Saccharomyces cerevisiae
taatcattat

SEQ ID NO: 1159 - DNA, 10 bp, Saccharomyces cerevisiae
tccctataag

SEQ ID NO: 1160 - DNA, 10 bp, Saccharomyces cerevisiae
tgtcacccca

SEQ ID NO: 1161 - DNA, 10 bp, Saccharomyces cerevisiae
tttacgataa

SEQ ID NO: 1162 - DNA, 10 bp, Saccharomyces cerevisiae
aagaggtcag

SEQ ID NO: 1163 - DNA, 10 bp, Saccharomyces cerevisiae
acaaagttat

SEQ ID NO: 1164 - DNA, 10 bp, Saccharomyces cerevisiae
attaagcgta

SEQ ID NO: 1165 - DNA, 10 bp, Saccharomyces cerevisiae
caagaagcta

SEQ ID NO: 1166 - DNA, 10 bp, Saccharomyces cerevisiae
catagctaat

SEQ ID NO: 1167 - DNA, 10 bp, Saccharomyces cerevisiae
ccaaggccat

SEQ ID NO: 1168 - DNA, 10 bp, Saccharomyces cerevisiae
ccttcaagaa

SEQ ID NO: 1169 - DNA, 10 bp, Saccharomyces cerevisiae
gaagaacgtg

SEQ ID NO: 1170 - DNA, 10 bp, Saccharomyces cerevisiae
gttgcctcag

SEQ ID NO: 1171 - DNA, 10 bp, Saccharomyces cerevisiae
gtttcctttc

SEQ ID NO: 1172 - DNA, 10 bp, Saccharomyces cerevisiae
taaatggaac

SEQ ID NO: 1173 - DNA, 10 bp, Saccharomyces cerevisiae
tgtgtatgaa

SEQ ID NO: 1174 - DNA, 10 bp, Saccharomyces cerevisiae
tttctggtga

SEQ ID NO: 1175 - DNA, 10 bp, Saccharomyces cerevisiae
aaacgatact

SEQ ID NO: 1176 - DNA, 10 bp, Saccharomyces cerevisiae
accactagag

SEQ ID NO: 1177 - DNA, 10 bp, Saccharomyces cerevisiae
agaaaggata

SEQ ID NO: 1178 - DNA, 10 bp, Saccharomyces cerevisiae
agagccataa

SEQ ID NO: 1179 - DNA, 10 bp, Saccharomyces cerevisiae
atgatggcat

SEQ ID NO: 1180 - DNA, 10 bp, Saccharomyces cerevisiae
attgaatcaa

SEQ ID NO: 1181 - DNA, 10 bp, Saccharomyces cerevisiae
cagcctttaa

SEQ ID NO: 1182 - DNA, 10 bp, Saccharomyces cerevisiae
ccaaagctgc

SEQ ID NO: 1183 - DNA, 10 bp, Saccharomyces cerevisiae
ctccctcaat

SEQ ID NO: 1184 - DNA, 10 bp, Saccharomyces cerevisiae
ctgactcctt

SEQ ID NO: 1185 - DNA, 10 bp, Saccharomyces cerevisiae
gaaaaaaact

SEQ ID NO: 1186 - DNA, 10 bp, Saccharomyces cerevisiae
gagggatcca

SEQ ID NO: 1187 - DNA, 10 bp, Saccharomyces cerevisiae
gcgccaatag

SEQ ID NO: 1188 - DNA, 10 bp, Saccharomyces cerevisiae
gcttctggca

SEQ ID NO: 1189 - DNA, 10 bp, Saccharomyces cerevisiae
ggttgatgcg

SEQ ID NO: 1190 - DNA, 10 bp, Saccharomyces cerevisiae
gtcttatttt

SEQ ID NO: 1191 - DNA, 10 bp, Saccharomyces cerevisiae
gttggatgga

SEQ ID NO: 1192 - DNA, 10 bp, Saccharomyces cerevisiae
gtttactgtt

SEQ ID NO: 1193 - DNA, 10 bp, Saccharomyces cerevisiae
tataataatt

SEQ ID NO: 1194 - DNA, 10 bp, Saccharomyces cerevisiae
tccgaatatg

SEQ ID NO: 1195 - DNA, 10 bp, Saccharomyces cerevisiae
tccttagcgc

SEQ ID NO: 1196 - DNA, 10 bp, Saccharomyces cerevisiae
tccttgtcta

SEQ ID NO: 1197 - DNA, 10 bp, Saccharomyces cerevisiae
tcgttaaaat

SEQ ID NO: 1198 - DNA, 10 bp, Saccharomyces cerevisiae
tgtttgtatt

SEQ ID NO: 1199 - DNA, 10 bp, Saccharomyces cerevisiae
ttagtcaaaa

SEQ ID NO: 1200 - DNA, 10 bp, Saccharomyces cerevisiae
ttggggcaaa

SEQ ID NO: 1201 - DNA, 10 bp, Saccharomyces cerevisiae
aactgataga

SEQ ID NO: 1202 - DNA, 10 bp, Saccharomyces cerevisiae
acaaaatttg

SEQ ID NO: 1203 - DNA, 10 bp, Saccharomyces cerevisiae
acgaaggaat

SEQ ID NO: 1204 - DNA, 10 bp, Saccharomyces cerevisiae
acgagagatt

SEQ ID NO: 1205 - DNA, 10 bp, Saccharomyces cerevisiae
atgactgaac

SEQ ID NO: 1206 - DNA, 10 bp, Saccharomyces cerevisiae
atggaactat

SEQ ID NO: 1207 - DNA, 10 bp, Saccharomyces cerevisiae
attttgaaga

SEQ ID NO: 1208 - DNA, 10 bp, Saccharomyces cerevisiae
caaaggatct

SEQ ID NO: 1209 - DNA, 10 bp, Saccharomyces cerevisiae
cctgccttat

SEQ ID NO: 1210 - DNA, 10 bp, Saccharomyces cerevisiae
cgactgcgcc

SEQ ID NO: 1211 - DNA, 10 bp, Saccharomyces cerevisiae
ctaactggct

SEQ ID NO: 1212 - DNA, 10 bp, Saccharomyces cerevisiae
ctgtttatgg

SEQ ID NO: 1213 - DNA, 10 bp, Saccharomyces cerevisiae
gaaaacactt

SEQ ID NO: 1214 - DNA, 10 bp, Saccharomyces cerevisiae
gaacagacaa

SEQ ID NO: 1215 - DNA, 10 bp, Saccharomyces cerevisiae
gaataagctg

SEQ ID NO: 1216 - DNA, 10 bp, Saccharomyces cerevisiae
gcagaatgct

SEQ ID NO: 1217 - DNA, 10 bp, Saccharomyces cerevisiae
gcgtaagata

SEQ ID NO: 1218 - DNA, 10 bp, Saccharomyces cerevisiae
ggctccttat

SEQ ID NO: 1219 - DNA, 10 bp, Saccharomyces cerevisiae
gggagtatgg

SEQ ID NO: 1220 - DNA, 10 bp, Saccharomyces cerevisiae
gtttctgtgt

SEQ ID NO: 1221 - DNA, 10 bp, Saccharomyces cerevisiae
tacacaagta

SEQ ID NO: 1222 - DNA, 10 bp, Saccharomyces cerevisiae
tatatttttt

SEQ ID NO: 1223 - DNA, 10 bp, Saccharomyces cerevisiae
tatggcgtac

SEQ ID NO: 1224 - DNA, 10 bp, Saccharomyces cerevisiae
tctattgtca

SEQ ID NO: 1225 - DNA, 10 bp, Saccharomyces cerevisiae
aaaaagctag

SEQ ID NO: 1226 - DNA, 10 bp, Saccharomyces cerevisiae
aaaacgccat

SEQ ID NO: 1227 - DNA, 10 bp, Saccharomyces cerevisiae
aagtcaatag

SEQ ID NO: 1228 - DNA, 10 bp, Saccharomyces cerevisiae
aatcgtcata

SEQ ID NO: 1229 - DNA, 10 bp, Saccharomyces cerevisiae
acaaaaattc

SEQ ID NO: 1230 - DNA, 10 bp, Saccharomyces cerevisiae
accgccaccc

SEQ ID NO: 1231 - DNA, 10 bp, Saccharomyces cerevisiae
acttggagcc

SEQ ID NO: 1232 - DNA, 10 bp, Saccharomyces cerevisiae
agatggattc

SEQ ID NO: 1233 - DNA, 10 bp, Saccharomyces cerevisiae
atcacgctct

SEQ ID NO: 1234 - DNA, 10 bp, Saccharomyces cerevisiae
atccaagctg

SEQ ID NO: 1235 - DNA, 10 bp, Saccharomyces cerevisiae
atcggtccag

SEQ ID NO: 1236 - DNA, 10 bp, Saccharomyces cerevisiae
atgacaaagg

SEQ ID NO: 1237 - DNA, 10 bp, Saccharomyces cerevisiae
gaagtcggaa

SEQ ID NO: 1238 - DNA, 10 bp, Saccharomyces cerevisiae
gaggtgctgt

SEQ ID NO: 1239 - DNA, 10 bp, Saccharomyces cerevisiae
gcgttcgcgg

SEQ ID NO: 1240 - DNA, 10 bp, Saccharomyces cerevisiae
ggatcggttt

SEQ ID NO: 1241 - DNA, 10 bp, Saccharomyces cerevisiae
ggatgctgtg

SEQ ID NO: 1242 - DNA, 10 bp, Saccharomyces cerevisiae
ggttttggcg

SEQ ID NO: 1243 - DNA, 10 bp, Saccharomyces cerevisiae
gtttcaagag

SEQ ID NO: 1244 - DNA, 10 bp, Saccharomyces cerevisiae
taagcggagt

SEQ ID NO: 1245 - DNA, 10 bp, Saccharomyces cerevisiae
tacattatac

SEQ ID NO: 1246 - DNA, 10 bp, Saccharomyces cerevisiae
tccagtgatg

SEQ ID NO: 1247 - DNA, 10 bp, Saccharomyces cerevisiae
tctaccgtca

SEQ ID NO: 1248 - DNA, 10 bp, Saccharomyces cerevisiae
tggatctcaa

SEQ ID NO: 1249 - DNA, 10 bp, Saccharomyces cerevisiae
tttattaatc

SEQ ID NO: 1250 - DNA, 10 bp, Saccharomyces cerevisiae
ttttaagata

SEQ ID NO: 1251 - DNA, 10 bp, Saccharomyces cerevisiae
aaaaacatat

SEQ ID NO: 1252 - DNA, 10 bp, Saccharomyces cerevisiae
aaagctaaca

SEQ ID NO: 1253 - DNA, 10 bp, Saccharomyces cerevisiae
aaggaattga

SEQ ID NO: 1254 - DNA, 10 bp, Saccharomyces cerevisiae
acagtgcaag

SEQ ID NO: 1255 - DNA, 10 bp, Saccharomyces cerevisiae
acatctcaaa

SEQ ID NO: 1256 - DNA, 10 bp, Saccharomyces cerevisiae
acatttttta

SEQ ID NO: 1257 - DNA, 10 bp, Saccharomyces cerevisiae
acccatcggt

SEQ ID NO: 1258 - DNA, 10 bp, Saccharomyces cerevisiae
acgtaggtga

SEQ ID NO: 1259 - DNA, 10 bp, Saccharomyces cerevisiae
acttttaaaa

SEQ ID NO: 1260 - DNA, 10 bp, Saccharomyces cerevisiae
atcgtgataa

SEQ ID NO: 1261 - DNA, 10 bp, Saccharomyces cerevisiae
caaaagactg

SEQ ID NO: 1262 - DNA, 10 bp, Saccharomyces cerevisiae
caaagagaag

SEQ ID NO: 1263 - DNA, 10 bp, Saccharomyces cerevisiae
cactttaatt

SEQ ID NO: 1264 - DNA, 10 bp, Saccharomyces cerevisiae
ccaccaatta

SEQ ID NO: 1265 - DNA, 10 bp, Saccharomyces cerevisiae
ccatacaggt

SEQ ID NO: 1266 - DNA, 10 bp, Saccharomyces cerevisiae
cctggcgtca

SEQ ID NO: 1267 - DNA, 10 bp, Saccharomyces cerevisiae
ctggctctaa

SEQ ID NO: 1268 - DNA, 10 bp, Saccharomyces cerevisiae
ctttggcatt

SEQ ID NO: 1269 - DNA, 10 bp, Saccharomyces cerevisiae
gaacacaaga

SEQ ID NO: 1270 - DNA, 10 bp, Saccharomyces cerevisiae
gataagatta

SEQ ID NO: 1271 - DNA, 10 bp, Saccharomyces cerevisiae
gatacctcct

SEQ ID NO: 1272 - DNA, 10 bp, Saccharomyces cerevisiae
gctgcctatg

SEQ ID NO: 1273 - DNA, 10 bp, Saccharomyces cerevisiae
gctttggcta

SEQ ID NO: 1274 - DNA, 10 bp, Saccharomyces cerevisiae
gtcatatgaa

SEQ ID NO: 1275 - DNA, 10 bp, Saccharomyces cerevisiae
gtctccgaag

SEQ ID NO: 1276 - DNA, 10 bp, Saccharomyces cerevisiae
taagcagcgt

SEQ ID NO: 1277 - DNA, 10 bp, Saccharomyces cerevisiae
tataagaact

SEQ ID NO: 1278 - DNA, 10 bp, Saccharomyces cerevisiae
tcattacatt

SEQ ID NO: 1279 - DNA, 10 bp, Saccharomyces cerevisiae
tcctccagaa

SEQ ID NO: 1280 - DNA, 10 bp, Saccharomyces cerevisiae
tgattataaa

SEQ ID NO: 1281 - DNA, 10 bp, Saccharomyces cerevisiae
tgtatgtgaa

SEQ ID NO: 1282 - DNA, 10 bp, Saccharomyces cerevisiae
ttgagtgagc

SEQ ID NO: 1283 - DNA, 10 bp, Saccharomyces cerevisiae
ttttatttcc

SEQ ID NO: 1284 - DNA, 10 bp, Saccharomyces cerevisiae
agcttattga

SEQ ID NO: 1285 - DNA, 10 bp, Saccharomyces cerevisiae
ataaaaaaaa

SEQ ID NO: 1286 - DNA, 10 bp, Saccharomyces cerevisiae
ataacaacaa

SEQ ID NO: 1287 - DNA, 10 bp, Saccharomyces cerevisiae
atatcaaaaa

SEQ ID NO: 1288 - DNA, 10 bp, Saccharomyces cerevisiae
atgcagattt

SEQ ID NO: 1289 - DNA, 10 bp, Saccharomyces cerevisiae
atgctgttat

SEQ ID NO: 1290 - DNA, 10 bp, Saccharomyces cerevisiae
atttgagtta

SEQ ID NO: 1291 - DNA, 10 bp, Saccharomyces cerevisiae
caaccagttt

SEQ ID NO: 1292 - DNA, 10 bp, Saccharomyces cerevisiae
ccaactagag

SEQ ID NO: 1293 - DNA, 10 bp, Saccharomyces cerevisiae
cgaacgtaaa

SEQ ID NO: 1294 - DNA, 10 bp, Saccharomyces cerevisiae
ctttctatat

SEQ ID NO: 1295 - DNA, 10 bp, Saccharomyces cerevisiae
ctttggctga

SEQ ID NO: 1296 - DNA, 10 bp, Saccharomyces cerevisiae
gaaatggaag

SEQ ID NO: 1297 - DNA, 10 bp, Saccharomyces cerevisiae
gaaccagctt

SEQ ID NO: 1298 - DNA, 10 bp, Saccharomyces cerevisiae
gaagtcgcaa

SEQ ID NO: 1299 - DNA, 10 bp, Saccharomyces cerevisiae
gaatgggata

SEQ ID NO: 1300 - DNA, 10 bp, Saccharomyces cerevisiae
gagactgcta

SEQ ID NO: 1301 - DNA, 10 bp, Saccharomyces cerevisiae
gataacaaaa

SEQ ID NO: 1302 - DNA, 10 bp, Saccharomyces cerevisiae
gctctagcgc

SEQ ID NO: 1303 - DNA, 10 bp, Saccharomyces cerevisiae
ggattataca

SEQ ID NO: 1304 - DNA, 10 bp, Saccharomyces cerevisiae
ggtgatgagg

SEQ ID NO: 1305 - DNA, 10 bp, Saccharomyces cerevisiae
gtccgccaaa

SEQ ID NO: 1306 - DNA, 10 bp, Saccharomyces cerevisiae
gtcgtacaga

SEQ ID NO: 1307 - DNA, 10 bp, Saccharomyces cerevisiae
taagaaacaa

SEQ ID NO: 1308 - DNA, 10 bp, Saccharomyces cerevisiae
tacaccgcat

SEQ ID NO: 1309 - DNA, 10 bp, Saccharomyces cerevisiae
tgcggcaact

SEQ ID NO: 1310 - DNA, 10 bp, Saccharomyces cerevisiae
tgctctgtgg

SEQ ID NO: 1311 - DNA, 10 bp, Saccharomyces cerevisiae
tgggatagac

SEQ ID NO: 1312 - DNA, 10 bp, Saccharomyces cerevisiae
tggtattaga

SEQ ID NO: 1313 - DNA, 10 bp, Saccharomyces cerevisiae
ttgcaataat

SEQ ID NO: 1314 - DNA, 10 bp, Saccharomyces cerevisiae
ttgctgtacg

SEQ ID NO: 1315 - DNA, 10 bp, Saccharomyces cerevisiae
tttttacgtt

SEQ ID NO: 1316 - DNA, 10 bp, Saccharomyces cerevisiae
tttttcgcta

SEQ ID NO: 1317 - DNA, 10 bp, Saccharomyces cerevisiae
aaacgaattt

SEQ ID NO: 1318 - DNA, 10 bp, Saccharomyces cerevisiae
aaagaactaa

SEQ ID NO: 1319 - DNA, 10 bp, Saccharomyces cerevisiae
aacttacggg

SEQ ID NO: 1320 - DNA, 10 bp, Saccharomyces cerevisiae
acacctgctg

SEQ ID NO: 1321 - DNA, 10 bp, Saccharomyces cerevisiae
acctgctcgg

SEQ ID NO: 1322 - DNA, 10 bp, Saccharomyces cerevisiae
acgaaaacat

SEQ ID NO: 1323 - DNA, 10 bp, Saccharomyces cerevisiae
aggtacattg

SEQ ID NO: 1324 - DNA, 10 bp, Saccharomyces cerevisiae
agttcagagt

SEQ ID NO: 1325 - DNA, 10 bp, Saccharomyces cerevisiae
attcttgatc

SEQ ID NO: 1326 - DNA, 10 bp, Saccharomyces cerevisiae
cactccagaa

SEQ ID NO: 1327 - DNA, 10 bp, Saccharomyces cerevisiae
cattcttctt

SEQ ID NO: 1328 - DNA, 10 bp, Saccharomyces cerevisiae
catttgtgta

SEQ ID NO: 1329 - DNA, 10 bp, Saccharomyces cerevisiae
ccaaatcaaa

SEQ ID NO: 1330 - DNA, 10 bp, Saccharomyces cerevisiae
ccaccacttc

SEQ ID NO: 1331 - DNA, 10 bp, Saccharomyces cerevisiae
ccttagtagt

SEQ ID NO: 1332 - DNA, 10 bp, Saccharomyces cerevisiae
cgagaggccc

SEQ ID NO: 1333 - DNA, 10 bp, Saccharomyces cerevisiae
cgcaaaaatt

SEQ ID NO: 1334 - DNA, 10 bp, Saccharomyces cerevisiae
ctttcgcaac

SEQ ID NO: 1335 - DNA, 10 bp, Saccharomyces cerevisiae
gaagttttcc

SEQ ID NO: 1336 - DNA, 10 bp, Saccharomyces cerevisiae
gaattgtcat

SEQ ID NO: 1337 - DNA, 10 bp, Saccharomyces cerevisiae
gcaagctcga

SEQ ID NO: 1338 - DNA, 10 bp, Saccharomyces cerevisiae
gcgatgtgta

SEQ ID NO: 1339 - DNA, 10 bp, Saccharomyces cerevisiae
gggtggtata

SEQ ID NO: 1340 - DNA, 10 bp, Saccharomyces cerevisiae
gggttcttcc

SEQ ID NO: 1341 - DNA, 10 bp, Saccharomyces cerevisiae
ggtcgttgat

SEQ ID NO: 1342 - DNA, 10 bp, Saccharomyces cerevisiae
gtaggtgatg

SEQ ID NO: 1343 - DNA, 10 bp, Saccharomyces cerevisiae
gtcattaacg

SEQ ID NO: 1344 - DNA, 10 bp, Saccharomyces cerevisiae
taaaaaaaaa

SEQ ID NO: 1345 - DNA, 10 bp, Saccharomyces cerevisiae
tatattctcg

SEQ ID NO: 1346 - DNA, 10 bp, Saccharomyces cerevisiae
ttaatttgct

SEQ ID NO: 1347 - DNA, 10 bp, Saccharomyces cerevisiae
ttactagcca

SEQ ID NO: 1348 - DNA, 10 bp, Saccharomyces cerevisiae
ttagtgaagt

SEQ ID NO: 1349 - DNA, 10 bp, Saccharomyces cerevisiae
ttgcacggta

SEQ ID NO: 1350 - DNA, 10 bp, Saccharomyces cerevisiae
tttggtggcg

SEQ ID NO: 1351 - DNA, 10 bp, Saccharomyces cerevisiae
tttgttccac

SEQ ID NO: 1352 - DNA, 10 bp, Saccharomyces cerevisiae
aacaagttgg

SEQ ID NO: 1353 - DNA, 10 bp, Saccharomyces cerevisiae
aacgcttggg

SEQ ID NO: 1354 - DNA, 10 bp, Saccharomyces cerevisiae
aagaagacca

SEQ ID NO: 1355 - DNA, 10 bp, Saccharomyces cerevisiae
aagcggtact

SEQ ID NO: 1356 - DNA, 10 bp, Saccharomyces cerevisiae
aatgaatatc

SEQ ID NO: 1357 - DNA, 10 bp, Saccharomyces cerevisiae
acggtcttac

SEQ ID NO: 1358 - DNA, 10 bp, Saccharomyces cerevisiae
aggcaaaatt

SEQ ID NO: 1359 - DNA, 10 bp, Saccharomyces cerevisiae
agggaagtaa

SEQ ID NO: 1360 - DNA, 10 bp, Saccharomyces cerevisiae
atctacgcta

SEQ ID NO: 1361 - DNA, 10 bp, Saccharomyces cerevisiae
attaacttcg

SEQ ID NO: 1362 - DNA, 10 bp, Saccharomyces cerevisiae
catcagcaac

SEQ ID NO: 1363 - DNA, 10 bp, Saccharomyces cerevisiae
ccacctcaat

SEQ ID NO: 1364 - DNA, 10 bp, Saccharomyces cerevisiae
ccttcaaaat

SEQ ID NO: 1365 - DNA, 10 bp, Saccharomyces cerevisiae
ctaaagacga

SEQ ID NO: 1366 - DNA, 10 bp, Saccharomyces cerevisiae
ctacggacga

SEQ ID NO: 1367 - DNA, 10 bp, Saccharomyces cerevisiae
gaaaactctc

SEQ ID NO: 1368 - DNA, 10 bp, Saccharomyces cerevisiae
gaaatacggc

SEQ ID NO: 1369 - DNA, 10 bp, Saccharomyces cerevisiae
gaacgagtaa

SEQ ID NO: 1370 - DNA, 10 bp, Saccharomyces cerevisiae
gaagaactgg

SEQ ID NO: 1371 - DNA, 10 bp, Saccharomyces cerevisiae
gaagagaatg

SEQ ID NO: 1372 - DNA, 10 bp, Saccharomyces cerevisiae
gagacaccca

SEQ ID NO: 1373 - DNA, 10 bp, Saccharomyces cerevisiae
gcaatgtaaa

SEQ ID NO: 1374 - DNA, 10 bp, Saccharomyces cerevisiae
gcacaagctc

SEQ ID NO: 1375 - DNA, 10 bp, Saccharomyces cerevisiae
ggagaaatcg

SEQ ID NO: 1376 - DNA, 10 bp, Saccharomyces cerevisiae
ggcctcaaag

SEQ ID NO: 1377 - DNA, 10 bp, Saccharomyces cerevisiae
ggcgagatgc

SEQ ID NO: 1378 - DNA, 10 bp, Saccharomyces cerevisiae
gggctctcgt

SEQ ID NO: 1379 - DNA, 10 bp, Saccharomyces cerevisiae
ggtttcccag

SEQ ID NO: 1380 - DNA, 10 bp, Saccharomyces cerevisiae
gttctacaga

SEQ ID NO: 1381 - DNA, 10 bp, Saccharomyces cerevisiae
gttgccagaa

SEQ ID NO: 1382 - DNA, 10 bp, Saccharomyces cerevisiae
gttgtgggat

SEQ ID NO: 1383 - DNA, 10 bp, Saccharomyces cerevisiae
tccttcagta

SEQ ID NO: 1384 - DNA, 10 bp, Saccharomyces cerevisiae
tgaacaaata

SEQ ID NO: 1385 - DNA, 10 bp, Saccharomyces cerevisiae
tgctaagaac

SEQ ID NO: 1386 - DNA, 10 bp, Saccharomyces cerevisiae
tggcaaaact

SEQ ID NO: 1387 - DNA, 10 bp, Saccharomyces cerevisiae
tttcaagatg

SEQ ID NO: 1388 - DNA, 10 bp, Saccharomyces cerevisiae
tttccgcgga

SEQ ID NO: 1389 - DNA, 10 bp, Saccharomyces cerevisiae
tttttctttt

SEQ ID NO: 1390 - DNA, 10 bp, Saccharomyces cerevisiae
aaaaatcaca

SEQ ID NO: 1391 - DNA, 10 bp, Saccharomyces cerevisiae
aaacaattta

SEQ ID NO: 1392 - DNA, 10 bp, Saccharomyces cerevisiae
aaatagggtc

SEQ ID NO: 1393 - DNA, 10 bp, Saccharomyces cerevisiae
aaatgggact

SEQ ID NO: 1394 - DNA, 10 bp, Saccharomyces cerevisiae
aacgcttttc

SEQ ID NO: 1395 - DNA, 10 bp, Saccharomyces cerevisiae
aagattagat

SEQ ID NO: 1396 - DNA, 10 bp, Saccharomyces cerevisiae
aagcataaaa

SEQ ID NO: 1397 - DNA, 10 bp, Saccharomyces cerevisiae
aaggataaaa

SEQ ID NO: 1398 - DNA, 10 bp, Saccharomyces cerevisiae
agaaaagtat

SEQ ID NO: 1399 - DNA, 10 bp, Saccharomyces cerevisiae
agcctattta

SEQ ID NO: 1400 - DNA, 10 bp, Saccharomyces cerevisiae
agctctctta

SEQ ID NO: 1401 - DNA, 10 bp, Saccharomyces cerevisiae
agggactgtt

SEQ ID NO: 1402 - DNA, 10 bp, Saccharomyces cerevisiae
ataaaatttt

SEQ ID NO: 1403 - DNA, 10 bp, Saccharomyces cerevisiae
atggttacta

SEQ ID NO: 1404 - DNA, 10 bp, Saccharomyces cerevisiae
caagttttgt

SEQ ID NO: 1405 - DNA, 10 bp, Saccharomyces cerevisiae
caatgaaccg

SEQ ID NO: 1406 - DNA, 10 bp, Saccharomyces cerevisiae
catacactga

SEQ ID NO: 1407 - DNA, 10 bp, Saccharomyces cerevisiae
catatggcca

SEQ ID NO: 1408 - DNA, 10 bp, Saccharomyces cerevisiae
catcattgat

SEQ ID NO: 1409 - DNA, 10 bp, Saccharomyces cerevisiae
cgggatatcc

SEQ ID NO: 1410 - DNA, 10 bp, Saccharomyces cerevisiae
ctcacaaaaa

SEQ ID NO: 1411 - DNA, 10 bp, Saccharomyces cerevisiae
ctgcagctga

SEQ ID NO: 1412 - DNA, 10 bp, Saccharomyces cerevisiae
ctggcaaaaa

SEQ ID NO: 1413 - DNA, 10 bp, Saccharomyces cerevisiae
cttgtggttt

SEQ ID NO: 1414 - DNA, 10 bp, Saccharomyces cerevisiae
gaaatccaaa

SEQ ID NO: 1415 - DNA, 10 bp, Saccharomyces cerevisiae
gaagccttct

SEQ ID NO: 1416 - DNA, 10 bp, Saccharomyces cerevisiae
gaataaaaag

SEQ ID NO: 1417 - DNA, 10 bp, Saccharomyces cerevisiae
gacgacaaac

SEQ ID NO: 1418 - DNA, 10 bp, Saccharomyces cerevisiae
gaggatagag

SEQ ID NO: 1419 - DNA, 10 bp, Saccharomyces cerevisiae
gatgtcgacg

SEQ ID NO: 1420 - DNA, 10 bp, Saccharomyces cerevisiae
gatgtggtga

SEQ ID NO: 1421 - DNA, 10 bp, Saccharomyces cerevisiae
gatttcatca

SEQ ID NO: 1422 - DNA, 10 bp, Saccharomyces cerevisiae
gcatcttgtt

SEQ ID NO: 1423 - DNA, 10 bp, Saccharomyces cerevisiae
gcttgaacaa

SEQ ID NO: 1424 - DNA, 10 bp, Saccharomyces cerevisiae
ggagagagtg

SEQ ID NO: 1425 - DNA, 10 bp, Saccharomyces cerevisiae
ggcatccgcc

SEQ ID NO: 1426 - DNA, 10 bp, Saccharomyces cerevisiae
gttcgagaca

SEQ ID NO: 1427 - DNA, 10 bp, Saccharomyces cerevisiae
gttttcgaaa

SEQ ID NO: 1428 - DNA, 10 bp, Saccharomyces cerevisiae
taattactag

SEQ ID NO: 1429 - DNA, 10 bp, Saccharomyces cerevisiae
tataaattac

SEQ ID NO: 1430 - DNA, 10 bp, Saccharomyces cerevisiae
tatcgctggt

SEQ ID NO: 1431 - DNA, 10 bp, Saccharomyces cerevisiae
tatgtctgta

SEQ ID NO: 1432 - DNA, 10 bp, Saccharomyces cerevisiae
tcaagtttca

SEQ ID NO: 1433 - DNA, 10 bp, Saccharomyces cerevisiae
tccccgtact

SEQ ID NO: 1434 - DNA, 10 bp, Saccharomyces cerevisiae
tcctattaag

SEQ ID NO: 1435 - DNA, 10 bp, Saccharomyces cerevisiae
tctactttga

SEQ ID NO: 1436 - DNA, 10 bp, Saccharomyces cerevisiae
tgaagaagct

SEQ ID NO: 1437 - DNA, 10 bp, Saccharomyces cerevisiae
tgaatgactc

SEQ ID NO: 1438 - DNA, 10 bp, Saccharomyces cerevisiae
ttagagagac

SEQ ID NO: 1439 - DNA, 10 bp, Saccharomyces cerevisiae
ttcacgtact

SEQ ID NO: 1440 - DNA, 10 bp, Saccharomyces cerevisiae
ttttcttttt

SEQ ID NO: 1441 - DNA, 10 bp, Saccharomyces cerevisiae
aaacttttgg

SEQ ID NO: 1442 - DNA, 10 bp, Saccharomyces cerevisiae
aaatgcaaaa

SEQ ID NO: 1443 - DNA, 10 bp, Saccharomyces cerevisiae
aattcgaaca

SEQ ID NO: 1444 - DNA, 10 bp, Saccharomyces cerevisiae
accagtgatg

SEQ ID NO: 1445 - DNA, 10 bp, Saccharomyces cerevisiae
accgataacg

SEQ ID NO: 1446 - DNA, 10 bp, Saccharomyces cerevisiae
actccgggcg

SEQ ID NO: 1447 - DNA, 10 bp, Saccharomyces cerevisiae
actgctggta

SEQ ID NO: 1448 - DNA, 10 bp, Saccharomyces cerevisiae
actttttcgc

SEQ ID NO: 1449 - DNA, 10 bp, Saccharomyces cerevisiae
agatgctcat

SEQ ID NO: 1450 - DNA, 10 bp, Saccharomyces cerevisiae
agattgccac

SEQ ID NO: 1451 - DNA, 10 bp, Saccharomyces cerevisiae
agttaggcac

SEQ ID NO: 1452 - DNA, 10 bp, Saccharomyces cerevisiae
atctttttca

SEQ ID NO: 1453 - DNA, 10 bp, Saccharomyces cerevisiae
attttttgat

SEQ ID NO: 1454 - DNA, 10 bp, Saccharomyces cerevisiae
cacattttca

SEQ ID NO: 1455 - DNA, 10 bp, Saccharomyces cerevisiae
cactctggac

SEQ ID NO: 1456 - DNA, 10 bp, Saccharomyces cerevisiae
cagctaaaga

SEQ ID NO: 1457 - DNA, 10 bp, Saccharomyces cerevisiae
catttgcaag

SEQ ID NO: 1458 - DNA, 10 bp, Saccharomyces cerevisiae
ccctaattaa

SEQ ID NO: 1459 - DNA, 10 bp, Saccharomyces cerevisiae
ccctattaag

SEQ ID NO: 1460 - DNA, 10 bp, Saccharomyces cerevisiae
cgcctccagt

SEQ ID NO: 1461 - DNA, 10 bp, Saccharomyces cerevisiae
cggtgtaaga

SEQ ID NO: 1462 - DNA, 10 bp, Saccharomyces cerevisiae
ctaagaaggt

SEQ ID NO: 1463 - DNA, 10 bp, Saccharomyces cerevisiae
ctgaacaaag

SEQ ID NO: 1464 - DNA, 10 bp, Saccharomyces cerevisiae
ctgatggtag

SEQ ID NO: 1465 - DNA, 10 bp, Saccharomyces cerevisiae
ctgctcaatt

SEQ ID NO: 1466 - DNA, 10 bp, Saccharomyces cerevisiae
ctggagggga

SEQ ID NO: 1467 - DNA, 10 bp, Saccharomyces cerevisiae
ctggcaaagt

SEQ ID NO: 1468 - DNA, 10 bp, Saccharomyces cerevisiae
cttgatctca

SEQ ID NO: 1469 - DNA, 10 bp, Saccharomyces cerevisiae
gaaatttgct

SEQ ID NO: 1470 - DNA, 10 bp, Saccharomyces cerevisiae
gacaattcaa

SEQ ID NO: 1471 - DNA, 10 bp, Saccharomyces cerevisiae
gaggaaagct

SEQ ID NO: 1472 - DNA, 10 bp, Saccharomyces cerevisiae
gattagatta

SEQ ID NO: 1473 - DNA, 10 bp, Saccharomyces cerevisiae
gatttaaact

SEQ ID NO: 1474 - DNA, 10 bp, Saccharomyces cerevisiae
gcaagaagga

SEQ ID NO: 1475 - DNA, 10 bp, Saccharomyces cerevisiae
gcatcgtcat

SEQ ID NO: 1476 - DNA, 10 bp, Saccharomyces cerevisiae
gctacttgtc

SEQ ID NO: 1477 - DNA, 10 bp, Saccharomyces cerevisiae
gctgagaaac

SEQ ID NO: 1478 - DNA, 10 bp, Saccharomyces cerevisiae
ggcaatagat

SEQ ID NO: 1479 - DNA, 10 bp, Saccharomyces cerevisiae
gggaaagcta

SEQ ID NO: 1480 - DNA, 10 bp, Saccharomyces cerevisiae
ggtgaaacgt

SEQ ID NO: 1481 - DNA, 10 bp, Saccharomyces cerevisiae
ggttccggtt

SEQ ID NO: 1482 - DNA, 10 bp, Saccharomyces cerevisiae
gtgacacgct

SEQ ID NO: 1483 - DNA, 10 bp, Saccharomyces cerevisiae
tacgtaagtt

SEQ ID NO: 1484 - DNA, 10 bp, Saccharomyces cerevisiae
tactgagata

SEQ ID NO: 1485 - DNA, 10 bp, Saccharomyces cerevisiae
tagatgttac

SEQ ID NO: 1486 - DNA, 10 bp, Saccharomyces cerevisiae
tagctgcaaa

SEQ ID NO: 1487 - DNA, 10 bp, Saccharomyces cerevisiae
tataatgaaa

SEQ ID NO: 1488 - DNA, 10 bp, Saccharomyces cerevisiae
tcgcctttta

SEQ ID NO: 1489 - DNA, 10 bp, Saccharomyces cerevisiae
tctcctaaga

SEQ ID NO: 1490 - DNA, 10 bp, Saccharomyces cerevisiae
tctttatata

SEQ ID NO: 1491 - DNA, 10 bp, Saccharomyces cerevisiae
tgacaagtcc

SEQ ID NO: 1492 - DNA, 10 bp, Saccharomyces cerevisiae
tgattttaat

SEQ ID NO: 1493 - DNA, 10 bp, Saccharomyces cerevisiae
tgtttttccg

SEQ ID NO: 1494 - DNA, 10 bp, Saccharomyces cerevisiae
ttatcgttga

SEQ ID NO: 1495 - DNA, 10 bp, Saccharomyces cerevisiae
ttctagaatg

SEQ ID NO: 1496 - DNA, 10 bp, Saccharomyces cerevisiae
tttaattggt

SEQ ID NO: 1497 - DNA, 10 bp, Saccharomyces cerevisiae
tttccattgc

SEQ ID NO: 1498 - DNA, 10 bp, Saccharomyces cerevisiae
aaaaattgtt

SEQ ID NO: 1499 - DNA, 10 bp, Saccharomyces cerevisiae
aaagccgcct

SEQ ID NO: 1500 - DNA, 10 bp, Saccharomyces cerevisiae
aacttagttt

SEQ ID NO: 1501 - DNA, 10 bp, Saccharomyces cerevisiae
aagagattca

SEQ ID NO: 1502 - DNA, 10 bp, Saccharomyces cerevisiae
aagagtcaca

SEQ ID NO: 1503 - DNA, 10 bp, Saccharomyces cerevisiae
aaggaactat

SEQ ID NO: 1504 - DNA, 10 bp, Saccharomyces cerevisiae
aaggcgttcg

SEQ ID NO: 1505 - DNA, 10 bp, Saccharomyces cerevisiae
aattgaaata

SEQ ID NO: 1506 - DNA, 10 bp, Saccharomyces cerevisiae
accaccacca

SEQ ID NO: 1507 - DNA, 10 bp, Saccharomyces cerevisiae
acccagaagt

SEQ ID NO: 1508 - DNA, 10 bp, Saccharomyces cerevisiae
acgacataga

SEQ ID NO: 1509 - DNA, 10 bp, Saccharomyces cerevisiae
actcaaattt

SEQ ID NO: 1510 - DNA, 10 bp, Saccharomyces cerevisiae
agaattgagt

SEQ ID NO: 1511 - DNA, 10 bp, Saccharomyces cerevisiae
agacagttag

SEQ ID NO: 1512 - DNA, 10 bp, Saccharomyces cerevisiae
aggaactcgc

SEQ ID NO: 1513 - DNA, 10 bp, Saccharomyces cerevisiae
aggcaaaaac

SEQ ID NO: 1514 - DNA, 10 bp, Saccharomyces cerevisiae
agtagattca

SEQ ID NO: 1515 - DNA, 10 bp, Saccharomyces cerevisiae
atgaagaaac

SEQ ID NO: 1516 - DNA, 10 bp, Saccharomyces cerevisiae
attttagttt

SEQ ID NO: 1517 - DNA, 10 bp, Saccharomyces cerevisiae
caatggccca

SEQ ID NO: 1518 - DNA, 10 bp, Saccharomyces cerevisiae
cagcaggttt

SEQ ID NO: 1519 - DNA, 10 bp, Saccharomyces cerevisiae
caggagctaa

SEQ ID NO: 1520 - DNA, 10 bp, Saccharomyces cerevisiae
cagttgctgc

SEQ ID NO: 1521 - DNA, 10 bp, Saccharomyces cerevisiae
catatgtatg

SEQ ID NO: 1522 - DNA, 10 bp, Saccharomyces cerevisiae
ccaggttctg

SEQ ID NO: 1523 - DNA, 10 bp, Saccharomyces cerevisiae
ccccatttcc

SEQ ID NO: 1524 - DNA, 10 bp, Saccharomyces cerevisiae
ccgttacctc

SEQ ID NO: 1525 - DNA, 10 bp, Saccharomyces cerevisiae
ctgatcaagg

SEQ ID NO: 1526 - DNA, 10 bp, Saccharomyces cerevisiae
ctggaattat

SEQ ID NO: 1527 - DNA, 10 bp, Saccharomyces cerevisiae
gaaaaaaaaa

SEQ ID NO: 1528 - DNA, 10 bp, Saccharomyces cerevisiae
gacggcgccg

SEQ ID NO: 1529 - DNA, 10 bp, Saccharomyces cerevisiae
gagaacatta

SEQ ID NO: 1530 - DNA, 10 bp, Saccharomyces cerevisiae
gagcaatcca

SEQ ID NO: 1531 - DNA, 10 bp, Saccharomyces cerevisiae
gatcaccgac

SEQ ID NO: 1532 - DNA, 10 bp, Saccharomyces cerevisiae
gcaacaaaag

SEQ ID NO: 1533 - DNA, 10 bp, Saccharomyces cerevisiae
gcaatggctg

SEQ ID NO: 1534 - DNA, 10 bp, Saccharomyces cerevisiae
gcaggtgctg

SEQ ID NO: 1535 - DNA, 10 bp, Saccharomyces cerevisiae
gcagtagaag

SEQ ID NO: 1536 - DNA, 10 bp, Saccharomyces cerevisiae
gcgaaagagc

SEQ ID NO: 1537 - DNA, 10 bp, Saccharomyces cerevisiae
gcgcctccaa

SEQ ID NO: 1538 - DNA, 10 bp, Saccharomyces cerevisiae
gcgctgaaga

SEQ ID NO: 1539 - DNA, 10 bp, Saccharomyces cerevisiae
gcgtgaaacg

SEQ ID NO: 1540 - DNA, 10 bp, Saccharomyces cerevisiae
gctccgtcgt

SEQ ID NO: 1541 - DNA, 10 bp, Saccharomyces cerevisiae
ggataaataa

SEQ ID NO: 1542 - DNA, 10 bp, Saccharomyces cerevisiae
ggatattacc

SEQ ID NO: 1543 - DNA, 10 bp, Saccharomyces cerevisiae
ggcaacacct

SEQ ID NO: 1544 - DNA, 10 bp, Saccharomyces cerevisiae
ggccactagt

SEQ ID NO: 1545 - DNA, 10 bp, Saccharomyces cerevisiae
ggccgataaa

SEQ ID NO: 1546 - DNA, 10 bp, Saccharomyces cerevisiae
gggtgttaac

SEQ ID NO: 1547 - DNA, 10 bp, Saccharomyces cerevisiae
ggtggattct

SEQ ID NO: 1548 - DNA, 10 bp, Saccharomyces cerevisiae
gtaaatttca

SEQ ID NO: 1549 - DNA, 10 bp, Saccharomyces cerevisiae
gtgtcggacg

SEQ ID NO: 1550 - DNA, 10 bp, Saccharomyces cerevisiae
gttggtgaat

SEQ ID NO: 1551 - DNA, 10 bp, Saccharomyces cerevisiae
gttggttttg

SEQ ID NO: 1552 - DNA, 10 bp, Saccharomyces cerevisiae
tacataaagt

SEQ ID NO: 1553 - DNA, 10 bp, Saccharomyces cerevisiae
tacccgtaga

SEQ ID NO: 1554 - DNA, 10 bp, Saccharomyces cerevisiae
tatgaaggac

SEQ ID NO: 1555 - DNA, 10 bp, Saccharomyces cerevisiae
tcattcaagt

SEQ ID NO: 1556 - DNA, 10 bp, Saccharomyces cerevisiae
tccccgacat

SEQ ID NO: 1557 - DNA, 10 bp, Saccharomyces cerevisiae
tctctgacag

SEQ ID NO: 1558 - DNA, 10 bp, Saccharomyces cerevisiae
tctgcgctct

SEQ ID NO: 1559 - DNA, 10 bp, Saccharomyces cerevisiae
tgatagccat

SEQ ID NO: 1560 - DNA, 10 bp, Saccharomyces cerevisiae
tgattgtcgg

SEQ ID NO: 1561 - DNA, 10 bp, Saccharomyces cerevisiae
tgccagactc

SEQ ID NO: 1562 - DNA, 10 bp, Saccharomyces cerevisiae
tgctgaattg

SEQ ID NO: 1563 - DNA, 10 bp, Saccharomyces cerevisiae
tggctgagga

SEQ ID NO: 1564 - DNA, 10 bp, Saccharomyces cerevisiae
tggttgtcta

SEQ ID NO: 1565 - DNA, 10 bp, Saccharomyces cerevisiae
ttacgtttag

SEQ ID NO: 1566 - DNA, 10 bp, Saccharomyces cerevisiae
ttatcagagg

SEQ ID NO: 1567 - DNA, 10 bp, Saccharomyces cerevisiae
ttcgtttact

SEQ ID NO: 1568 - DNA, 10 bp, Saccharomyces cerevisiae
ttctgtgtga

SEQ ID NO: 1569 - DNA, 10 bp, Saccharomyces cerevisiae
ttcttaccca

SEQ ID NO: 1570 - DNA, 10 bp, Saccharomyces cerevisiae
ttgatttgga

SEQ ID NO: 1571 - DNA, 10 bp, Saccharomyces cerevisiae
ttgtgagtac

SEQ ID NO: 1572 - DNA, 10 bp, Saccharomyces cerevisiae
tttccgtctc

SEQ ID NO: 1573 - DNA, 10 bp, Saccharomyces cerevisiae
tttcgggcac

SEQ ID NO: 1574 - DNA, 10 bp, Saccharomyces cerevisiae
tttctaaaaa

SEQ ID NO: 1575 - DNA, 10 bp, Saccharomyces cerevisiae
tttgaaccac

SEQ ID NO: 1576 - DNA, 10 bp, Saccharomyces cerevisiae
aaaatgtagg

SEQ ID NO: 1577 - DNA, 10 bp, Saccharomyces cerevisiae
aaacaagttc

SEQ ID NO: 1578 - DNA, 10 bp, Saccharomyces cerevisiae
aaagaagaag

SEQ ID NO: 1579 - DNA, 10 bp, Saccharomyces cerevisiae
aaattaatgt

SEQ ID NO: 1580 - DNA, 10 bp, Saccharomyces cerevisiae
aaattgatta

SEQ ID NO: 1581 - DNA, 10 bp, Saccharomyces cerevisiae
aacgttcgtg

SEQ ID NO: 1582 - DNA, 10 bp, Saccharomyces cerevisiae
aagaaaaggc

SEQ ID NO: 1583 - DNA, 10 bp, Saccharomyces cerevisiae
aagacgaaga

SEQ ID NO: 1584 - DNA, 10 bp, Saccharomyces cerevisiae
aagggttatg

SEQ ID NO: 1585 - DNA, 10 bp, Saccharomyces cerevisiae
aatcgacttt

SEQ ID NO: 1586 - DNA, 10 bp, Saccharomyces cerevisiae
aatgaaagtc

SEQ ID NO: 1587 - DNA, 10 bp, Saccharomyces cerevisiae
acacgggccg

SEQ ID NO: 1588 - DNA, 10 bp, Saccharomyces cerevisiae
acattcctgg

SEQ ID NO: 1589 - DNA, 10 bp, Saccharomyces cerevisiae
acccacgtgt

SEQ ID NO: 1590 - DNA, 10 bp, Saccharomyces cerevisiae
actccactac

SEQ ID NO: 1591 - DNA, 10 bp, Saccharomyces cerevisiae
actgtgttca

SEQ ID NO: 1592 - DNA, 10 bp, Saccharomyces cerevisiae
actgttacct

SEQ ID NO: 1593 - DNA, 10 bp, Saccharomyces cerevisiae
agacaactgt

SEQ ID NO: 1594 - DNA, 10 bp, Saccharomyces cerevisiae
agacttgtct

SEQ ID NO: 1595 - DNA, 10 bp, Saccharomyces cerevisiae
aggagtcatc

SEQ ID NO: 1596 - DNA, 10 bp, Saccharomyces cerevisiae
atatttgttc

SEQ ID NO: 1597 - DNA, 10 bp, Saccharomyces cerevisiae
atctgtattt

SEQ ID NO: 1598 - DNA, 10 bp, Saccharomyces cerevisiae
atgctgccca

SEQ ID NO: 1599 - DNA, 10 bp, Saccharomyces cerevisiae
atttcagatt

SEQ ID NO: 1600 - DNA, 10 bp, Saccharomyces cerevisiae
attttgttgt

SEQ ID NO: 1601 - DNA, 10 bp, Saccharomyces cerevisiae
catatatatt

SEQ ID NO: 1602 - DNA, 10 bp, Saccharomyces cerevisiae
cctttgaaga

SEQ ID NO: 1603 - DNA, 10 bp, Saccharomyces cerevisiae
cgaataaaaa

SEQ ID NO: 1604 - DNA, 10 bp, Saccharomyces cerevisiae
cgagagaggt

SEQ ID NO: 1605 - DNA, 10 bp, Saccharomyces cerevisiae
cgcatatgct

SEQ ID NO: 1606 - DNA, 10 bp, Saccharomyces cerevisiae
cgcctccctc

SEQ ID NO: 1607 - DNA, 10 bp, Saccharomyces cerevisiae
cggggtatcg

SEQ ID NO: 1608 - DNA, 10 bp, Saccharomyces cerevisiae
cggtaaatcc

SEQ ID NO: 1609 - DNA, 10 bp, Saccharomyces cerevisiae
cttatataaa

SEQ ID NO: 1610 - DNA, 10 bp, Saccharomyces cerevisiae
gaaataggta

SEQ ID NO: 1611 - DNA, 10 bp, Saccharomyces cerevisiae
gaaccatatt

SEQ ID NO: 1612 - DNA, 10 bp, Saccharomyces cerevisiae
gaaggattgg

SEQ ID NO: 1613 - DNA, 10 bp, Saccharomyces cerevisiae
gacactttta

SEQ ID NO: 1614 - DNA, 10 bp, Saccharomyces cerevisiae
gacgcacgtt

SEQ ID NO: 1615 - DNA, 10 bp, Saccharomyces cerevisiae
gactatttgt

SEQ ID NO: 1616 - DNA, 10 bp, Saccharomyces cerevisiae
gagtgtttac

SEQ ID NO: 1617 - DNA, 10 bp, Saccharomyces cerevisiae
gatccagacg

SEQ ID NO: 1618 - DNA, 10 bp, Saccharomyces cerevisiae
gatggtagtg

SEQ ID NO: 1619 - DNA, 10 bp, Saccharomyces cerevisiae
gcacagaatt

SEQ ID NO: 1620 - DNA, 10 bp, Saccharomyces cerevisiae
gccgtggaag

SEQ ID NO: 1621 - DNA, 10 bp, Saccharomyces cerevisiae
gccttacaaa

SEQ ID NO: 1622 - DNA, 10 bp, Saccharomyces cerevisiae
gcgaaacagg

SEQ ID NO: 1623 - DNA, 10 bp, Saccharomyces cerevisiae
gctaagaacc

SEQ ID NO: 1624 - DNA, 10 bp, Saccharomyces cerevisiae
gctcttatac

SEQ ID NO: 1625 - DNA, 10 bp, Saccharomyces cerevisiae
ggatgcagaa

SEQ ID NO: 1626 - DNA, 10 bp, Saccharomyces cerevisiae
ggcgcaattt

SEQ ID NO: 1627 - DNA, 10 bp, Saccharomyces cerevisiae
ggctaggttt

SEQ ID NO: 1628 - DNA, 10 bp, Saccharomyces cerevisiae
ggcttacctt

SEQ ID NO: 1629 - DNA, 10 bp, Saccharomyces cerevisiae
gggaagagct

SEQ ID NO: 1630 - DNA, 10 bp, Saccharomyces cerevisiae
ggtgttacga

SEQ ID NO: 1631 - DNA, 10 bp, Saccharomyces cerevisiae
gtatagctca

SEQ ID NO: 1632 - DNA, 10 bp, Saccharomyces cerevisiae
gtcaccattg

SEQ ID NO: 1633 - DNA, 10 bp, Saccharomyces cerevisiae
gtcgtcgcca

SEQ ID NO: 1634 - DNA, 10 bp, Saccharomyces cerevisiae
gtgatgaact

SEQ ID NO: 1635 - DNA, 10 bp, Saccharomyces cerevisiae
gtgctgcctc

SEQ ID NO: 1636 - DNA, 10 bp, Saccharomyces cerevisiae
gttccatttg

SEQ ID NO: 1637 - DNA, 10 bp, Saccharomyces cerevisiae
gttggacggt

SEQ ID NO: 1638 - DNA, 10 bp, Saccharomyces cerevisiae
gtttctatat

SEQ ID NO: 1639 - DNA, 10 bp, Saccharomyces cerevisiae
taagtgatga

SEQ ID NO: 1640 - DNA, 10 bp, Saccharomyces cerevisiae
tatctatttt

SEQ ID NO: 1641 - DNA, 10 bp, Saccharomyces cerevisiae
tcaaggaact

SEQ ID NO: 1642 - DNA, 10 bp, Saccharomyces cerevisiae
tccccgtaat

SEQ ID NO: 1643 - DNA, 10 bp, Saccharomyces cerevisiae
tcgttaaaag

SEQ ID NO: 1644 - DNA, 10 bp, Saccharomyces cerevisiae
tgcatatatg

SEQ ID NO: 1645 - DNA, 10 bp, Saccharomyces cerevisiae
tgctttgaat

SEQ ID NO: 1646 - DNA, 10 bp, Saccharomyces cerevisiae
tggccttcaa

SEQ ID NO: 1647 - DNA, 10 bp, Saccharomyces cerevisiae
tggcggacat

SEQ ID NO: 1648 - DNA, 10 bp, Saccharomyces cerevisiae
tgggtcactg

SEQ ID NO: 1649 - DNA, 10 bp, Saccharomyces cerevisiae
tgtatacaaa

SEQ ID NO: 1650 - DNA, 10 bp, Saccharomyces cerevisiae
tgtcctcaat

SEQ ID NO: 1651 - DNA, 10 bp, Saccharomyces cerevisiae
ttaattcatc

SEQ ID NO: 1652 - DNA, 10 bp, Saccharomyces cerevisiae
ttgaggaacg

SEQ ID NO: 1653 - DNA, 10 bp, Saccharomyces cerevisiae
ttgtccgcac

SEQ ID NO: 1654 - DNA, 10 bp, Saccharomyces cerevisiae
ttgttgaatt

SEQ ID NO: 1655 - DNA, 10 bp, Saccharomyces cerevisiae
tttaagaaga

SEQ ID NO: 1656 - DNA, 10 bp, Saccharomyces cerevisiae
aaaagtcgtt

SEQ ID NO: 1657 - DNA, 10 bp, Saccharomyces cerevisiae
aaattaggta

SEQ ID NO: 1658 - DNA, 10 bp, Saccharomyces cerevisiae
aagctgaatt

SEQ ID NO: 1659 - DNA, 10 bp, Saccharomyces cerevisiae
aagctgctga

SEQ ID NO: 1660 - DNA, 10 bp, Saccharomyces cerevisiae
aaggacttgt

SEQ ID NO: 1661 - DNA, 10 bp, Saccharomyces cerevisiae
aataaaaaaa

SEQ ID NO: 1662 - DNA, 10 bp, Saccharomyces cerevisiae
aatatagaaa

SEQ ID NO: 1663 - DNA, 10 bp, Saccharomyces cerevisiae
aatcaattta

SEQ ID NO: 1664 - DNA, 10 bp, Saccharomyces cerevisiae
aatttccttt

SEQ ID NO: 1665 - DNA, 10 bp, Saccharomyces cerevisiae
acaaagatga

SEQ ID NO: 1666 - DNA, 10 bp, Saccharomyces cerevisiae
acatatgtta

SEQ ID NO: 1667 - DNA, 10 bp, Saccharomyces cerevisiae
acctgtgtac

SEQ ID NO: 1668 - DNA, 10 bp, Saccharomyces cerevisiae
acgacaactt

SEQ ID NO: 1669 - DNA, 10 bp, Saccharomyces cerevisiae
agacaaaacc

SEQ ID NO: 1670 - DNA, 10 bp, Saccharomyces cerevisiae
agcaggagtt

SEQ ID NO: 1671 - DNA, 10 bp, Saccharomyces cerevisiae
ataaattttc

SEQ ID NO: 1672 - DNA, 10 bp, Saccharomyces cerevisiae
atcaccaaag

SEQ ID NO: 1673 - DNA, 10 bp, Saccharomyces cerevisiae
atcagacaaa

SEQ ID NO: 1674 - DNA, 10 bp, Saccharomyces cerevisiae
atcagatggg

SEQ ID NO: 1675 - DNA, 10 bp, Saccharomyces cerevisiae
atcctagaaa

SEQ ID NO: 1676 - DNA, 10 bp, Saccharomyces cerevisiae
atgaaggtcc

SEQ ID NO: 1677 - DNA, 10 bp, Saccharomyces cerevisiae
atgaagtcgt

SEQ ID NO: 1678 - DNA, 10 bp, Saccharomyces cerevisiae
atgaccaacc

SEQ ID NO: 1679 - DNA, 10 bp, Saccharomyces cerevisiae
atgatcaacc

SEQ ID NO: 1680 - DNA, 10 bp, Saccharomyces cerevisiae
atgatcggga

SEQ ID NO: 1681 - DNA, 10 bp, Saccharomyces cerevisiae
atgctcggct

SEQ ID NO: 1682 - DNA, 10 bp, Saccharomyces cerevisiae
atgctttacc

SEQ ID NO: 1683 - DNA, 10 bp, Saccharomyces cerevisiae
atggacagtg

SEQ ID NO: 1684 - DNA, 10 bp, Saccharomyces cerevisiae
atggcaccga

SEQ ID NO: 1685 - DNA, 10 bp, Saccharomyces cerevisiae
atggggcacg

SEQ ID NO: 1686 - DNA, 10 bp, Saccharomyces cerevisiae
attcgttcta

SEQ ID NO: 1687 - DNA, 10 bp, Saccharomyces cerevisiae
caaaaaaaaa

SEQ ID NO: 1688 - DNA, 10 bp, Saccharomyces cerevisiae
caaatagttt

SEQ ID NO: 1689 - DNA, 10 bp, Saccharomyces cerevisiae
caagtagcaa

SEQ ID NO: 1690 - DNA, 10 bp, Saccharomyces cerevisiae
cacaagaata

SEQ ID NO: 1691 - DNA, 10 bp, Saccharomyces cerevisiae
cagaaaagaa

SEQ ID NO: 1692 - DNA, 10 bp, Saccharomyces cerevisiae
ccatttgctc

SEQ ID NO: 1693 - DNA, 10 bp, Saccharomyces cerevisiae
ccccttgata

SEQ ID NO: 1694 - DNA, 10 bp, Saccharomyces cerevisiae
ccctacacgg

SEQ ID NO: 1695 - DNA, 10 bp, Saccharomyces cerevisiae
cgacgggagt

SEQ ID NO: 1696 - DNA, 10 bp, Saccharomyces cerevisiae
ctagccgcat

SEQ ID NO: 1697 - DNA, 10 bp, Saccharomyces cerevisiae
ctattcgttg

SEQ ID NO: 1698 - DNA, 10 bp, Saccharomyces cerevisiae
cttcgacggc

SEQ ID NO: 1699 - DNA, 10 bp, Saccharomyces cerevisiae
gaaagaacga

SEQ ID NO: 1700 - DNA, 10 bp, Saccharomyces cerevisiae
gaaattattc

SEQ ID NO: 1701 - DNA, 10 bp, Saccharomyces cerevisiae
gaagcagtaa

SEQ ID NO: 1702 - DNA, 10 bp, Saccharomyces cerevisiae
gacaacttca

SEQ ID NO: 1703 - DNA, 10 bp, Saccharomyces cerevisiae
gacaattcat

SEQ ID NO: 1704 - DNA, 10 bp, Saccharomyces cerevisiae
gaggctggtt

SEQ ID NO: 1705 - DNA, 10 bp, Saccharomyces cerevisiae
gatttttatt

SEQ ID NO: 1706 - DNA, 10 bp, Saccharomyces cerevisiae
gcaagaaaaa

SEQ ID NO: 1707 - DNA, 10 bp, Saccharomyces cerevisiae
gcataaatac

SEQ ID NO: 1708 - DNA, 10 bp, Saccharomyces cerevisiae
gcattttttc

SEQ ID NO: 1709 - DNA, 10 bp, Saccharomyces cerevisiae
gccaaggaat

SEQ ID NO: 1710 - DNA, 10 bp, Saccharomyces cerevisiae
gcctacaact

SEQ ID NO: 1711 - DNA, 10 bp, Saccharomyces cerevisiae
gcgtaatgac

SEQ ID NO: 1712 - DNA, 10 bp, Saccharomyces cerevisiae
ggccacctat

SEQ ID NO: 1713 - DNA, 10 bp, Saccharomyces cerevisiae
ggtacagttg

SEQ ID NO: 1714 - DNA, 10 bp, Saccharomyces cerevisiae
ggtaccaact

SEQ ID NO: 1715 - DNA, 10 bp, Saccharomyces cerevisiae
ggtggatacc

SEQ ID NO: 1716 - DNA, 10 bp, Saccharomyces cerevisiae
gtaatacttt

SEQ ID NO: 1717 - DNA, 10 bp, Saccharomyces cerevisiae
gtaattggac

SEQ ID NO: 1718 - DNA, 10 bp, Saccharomyces cerevisiae
gtacctcatt

SEQ ID NO: 1719 - DNA, 10 bp, Saccharomyces cerevisiae
gtcaaggttt

SEQ ID NO: 1720 - DNA, 10 bp, Saccharomyces cerevisiae
gtccatcggc

SEQ ID NO: 1721 - DNA, 10 bp, Saccharomyces cerevisiae
gtcgtcaagc

SEQ ID NO: 1722 - DNA, 10 bp, Saccharomyces cerevisiae
gtctaaactg

SEQ ID NO: 1723 - DNA, 10 bp, Saccharomyces cerevisiae
gtgatggatg

SEQ ID NO: 1724 - DNA, 10 bp, Saccharomyces cerevisiae
gtgattttcc

SEQ ID NO: 1725 - DNA, 10 bp, Saccharomyces cerevisiae
gttatttgtc

SEQ ID NO: 1726 - DNA, 10 bp, Saccharomyces cerevisiae
gttttttctt

SEQ ID NO: 1727 - DNA, 10 bp, Saccharomyces cerevisiae
taaatgtgtc

SEQ ID NO: 1728 - DNA, 10 bp, Saccharomyces cerevisiae
taacaaaagt

SEQ ID NO: 1729 - DNA, 10 bp, Saccharomyces cerevisiae
taacagcgta

SEQ ID NO: 1730 - DNA, 10 bp, Saccharomyces cerevisiae
taacatatat

SEQ ID NO: 1731 - DNA, 10 bp, Saccharomyces cerevisiae
tacatattat

SEQ ID NO: 1732 - DNA, 10 bp, Saccharomyces cerevisiae
tacgtgtatt

SEQ ID NO: 1733 - DNA, 10 bp, Saccharomyces cerevisiae
tactacatac

SEQ ID NO: 1734 - DNA, 10 bp, Saccharomyces cerevisiae
tactactaaa

SEQ ID NO: 1735 - DNA, 10 bp, Saccharomyces cerevisiae
tactattgaa

SEQ ID NO: 1736 - DNA, 10 bp, Saccharomyces cerevisiae
tagatgcatc

SEQ ID NO: 1737 - DNA, 10 bp, Saccharomyces cerevisiae
tagttttttt

SEQ ID NO: 1738 - DNA, 10 bp, Saccharomyces cerevisiae
tatggtaaat

SEQ ID NO: 1739 - DNA, 10 bp, Saccharomyces cerevisiae
tatgtatctg

SEQ ID NO: 1740 - DNA, 10 bp, Saccharomyces cerevisiae
tcaaacatcc

SEQ ID NO: 1741 - DNA, 10 bp, Saccharomyces cerevisiae
tcagctaatt

SEQ ID NO: 1742 - DNA, 10 bp, Saccharomyces cerevisiae
tcatttgact

SEQ ID NO: 1743 - DNA, 10 bp, Saccharomyces cerevisiae
tccaaattct

SEQ ID NO: 1744 - DNA, 10 bp, Saccharomyces cerevisiae
tccagaacca

SEQ ID NO: 1745 - DNA, 10 bp, Saccharomyces cerevisiae
tcccattaag

SEQ ID NO: 1746 - DNA, 10 bp, Saccharomyces cerevisiae
tcgtaccttt

SEQ ID NO: 1747 - DNA, 10 bp, Saccharomyces cerevisiae
tctctccatt

SEQ ID NO: 1748 - DNA, 10 bp, Saccharomyces cerevisiae
tgctgctgaa

SEQ ID NO: 1749 - DNA, 10 bp, Saccharomyces cerevisiae
tgtatgtata

SEQ ID NO: 1750 - DNA, 10 bp, Saccharomyces cerevisiae
tgtgcgtata

SEQ ID NO: 1751 - DNA, 10 bp, Saccharomyces cerevisiae
ttacactaaa

SEQ ID NO: 1752 - DNA, 10 bp, Saccharomyces cerevisiae
ttatgaaaga

SEQ ID NO: 1753 - DNA, 10 bp, Saccharomyces cerevisiae
ttcacccttc

SEQ ID NO: 1754 - DNA, 10 bp, Saccharomyces cerevisiae
ttcagcagga

SEQ ID NO: 1755 - DNA, 10 bp, Saccharomyces cerevisiae
ttcgtctttt

SEQ ID NO: 1756 - DNA, 10 bp, Saccharomyces cerevisiae
ttcttgatga

SEQ ID NO: 1757 - DNA, 10 bp, Saccharomyces cerevisiae
tttgaatctg

SEQ ID NO: 1758 - DNA, 10 bp, Saccharomyces cerevisiae
tttgcgagaa

SEQ ID NO: 1759 - DNA, 10 bp, Saccharomyces cerevisiae
tttggtgctg

SEQ ID NO: 1760 - DNA, 10 bp, Saccharomyces cerevisiae
tttttcaaaa

SEQ ID NO: 1761 - DNA, 10 bp, Saccharomyces cerevisiae
aaagacatat

SEQ ID NO: 1762 - DNA, 10 bp, Saccharomyces cerevisiae
aaagagggaa

SEQ ID NO: 1763 - DNA, 10 bp, Saccharomyces cerevisiae
aaagttctag

SEQ ID NO: 1764 - DNA, 10 bp, Saccharomyces cerevisiae
aacaactcaa

SEQ ID NO: 1765 - DNA, 10 bp, Saccharomyces cerevisiae
aacaggcatc

SEQ ID NO: 1766 - DNA, 10 bp, Saccharomyces cerevisiae
aacattactt

SEQ ID NO: 1767 - DNA, 10 bp, Saccharomyces cerevisiae
aagagcaacg

SEQ ID NO: 1768 - DNA, 10 bp, Saccharomyces cerevisiae
aagctgagga

SEQ ID NO: 1769 - DNA, 10 bp, Saccharomyces cerevisiae
aagtgaagga

SEQ ID NO: 1770 - DNA, 10 bp, Saccharomyces cerevisiae
aatacacttt

SEQ ID NO: 1771 - DNA, 10 bp, Saccharomyces cerevisiae
aatgctccag

SEQ ID NO: 1772 - DNA, 10 bp, Saccharomyces cerevisiae
aattagtgga

SEQ ID NO: 1773 - DNA, 10 bp, Saccharomyces cerevisiae
acaatgaatt

SEQ ID NO: 1774 - DNA, 10 bp, Saccharomyces cerevisiae
accacttgga

SEQ ID NO: 1775 - DNA, 10 bp, Saccharomyces cerevisiae
accatccacg

SEQ ID NO: 1776 - DNA, 10 bp, Saccharomyces cerevisiae
acgaaattcc

SEQ ID NO: 1777 - DNA, 10 bp, Saccharomyces cerevisiae
actatcgaag

SEQ ID NO: 1778 - DNA, 10 bp, Saccharomyces cerevisiae
acttggcaaa

SEQ ID NO: 1779 - DNA, 10 bp, Saccharomyces cerevisiae
agaacttcgt

SEQ ID NO: 1780 - DNA, 10 bp, Saccharomyces cerevisiae
agaattggtt

SEQ ID NO: 1781 - DNA, 10 bp, Saccharomyces cerevisiae
agacgaactg

SEQ ID NO: 1782 - DNA, 10 bp, Saccharomyces cerevisiae
agagctttta

SEQ ID NO: 1783 - DNA, 10 bp, Saccharomyces cerevisiae
agcaaactgt

SEQ ID NO: 1784 - DNA, 10 bp, Saccharomyces cerevisiae
agcgtcctca

SEQ ID NO: 1785 - DNA, 10 bp, Saccharomyces cerevisiae
agctcattgg

SEQ ID NO: 1786 - DNA, 10 bp, Saccharomyces cerevisiae
aggatgaaga

SEQ ID NO: 1787 - DNA, 10 bp, Saccharomyces cerevisiae
agtgattctc

SEQ ID NO: 1788 - DNA, 10 bp, Saccharomyces cerevisiae
ataccttggt

SEQ ID NO: 1789 - DNA, 10 bp, Saccharomyces cerevisiae
atagcaccaa

SEQ ID NO: 1790 - DNA, 10 bp, Saccharomyces cerevisiae
ataggaaagc

SEQ ID NO: 1791 - DNA, 10 bp, Saccharomyces cerevisiae
atagtaacga

SEQ ID NO: 1792 - DNA, 10 bp, Saccharomyces cerevisiae
atagtaaggt

SEQ ID NO: 1793 - DNA, 10 bp, Saccharomyces cerevisiae
atatcaaaca

SEQ ID NO: 1794 - DNA, 10 bp, Saccharomyces cerevisiae
atcttgtcgt

SEQ ID NO: 1795 - DNA, 10 bp, Saccharomyces cerevisiae
atgctgaacc

SEQ ID NO: 1796 - DNA, 10 bp, Saccharomyces cerevisiae
atgctggtag

SEQ ID NO: 1797 - DNA, 10 bp, Saccharomyces cerevisiae
atgtcgcctc

SEQ ID NO: 1798 - DNA, 10 bp, Saccharomyces cerevisiae
atgtttctta

SEQ ID NO: 1799 - DNA, 10 bp, Saccharomyces cerevisiae
attcaagata

SEQ ID NO: 1800 - DNA, 10 bp, Saccharomyces cerevisiae
attgaatgaa

SEQ ID NO: 1801 - DNA, 10 bp, Saccharomyces cerevisiae
attgcatctc

SEQ ID NO: 1802 - DNA, 10 bp, Saccharomyces cerevisiae
caaagccatc

SEQ ID NO: 1803 - DNA, 10 bp, Saccharomyces cerevisiae
caaataaggg

SEQ ID NO: 1804 - DNA, 10 bp, Saccharomyces cerevisiae
caactgttga

SEQ ID NO: 1805 - DNA, 10 bp, Saccharomyces cerevisiae
caagacagtt

SEQ ID NO: 1806 - DNA, 10 bp, Saccharomyces cerevisiae
cacagcatca

SEQ ID NO: 1807 - DNA, 10 bp, Saccharomyces cerevisiae
cacatctata

SEQ ID NO: 1808 - DNA, 10 bp, Saccharomyces cerevisiae
cagagtttga

SEQ ID NO: 1809 - DNA, 10 bp, Saccharomyces cerevisiae
cagatataat

SEQ ID NO: 1810 - DNA, 10 bp, Saccharomyces cerevisiae
cagcaaataa

SEQ ID NO: 1811 - DNA, 10 bp, Saccharomyces cerevisiae
cagcagtgca

SEQ ID NO: 1812 - DNA, 10 bp, Saccharomyces cerevisiae
catactttca

SEQ ID NO: 1813 - DNA, 10 bp, Saccharomyces cerevisiae
catttttagt

SEQ ID NO: 1814 - DNA, 10 bp, Saccharomyces cerevisiae
catttttatg

SEQ ID NO: 1815 - DNA, 10 bp, Saccharomyces cerevisiae
ccaaaaggca

SEQ ID NO: 1816 - DNA, 10 bp, Saccharomyces cerevisiae
ccaaaaggga

SEQ ID NO: 1817 - DNA, 10 bp, Saccharomyces cerevisiae
ccctccctaa

SEQ ID NO: 1818 - DNA, 10 bp, Saccharomyces cerevisiae
ccgactacat

SEQ ID NO: 1819 - DNA, 10 bp, Saccharomyces cerevisiae
ccgttccgaa

SEQ ID NO: 1820 - DNA, 10 bp, Saccharomyces cerevisiae
cgcttgctat

SEQ ID NO: 1821 - DNA, 10 bp, Saccharomyces cerevisiae
cggttctacc

SEQ ID NO: 1822 - DNA, 10 bp, Saccharomyces cerevisiae
ctaaagagcc

SEQ ID NO: 1823 - DNA, 10 bp, Saccharomyces cerevisiae
ctaagcagga

SEQ ID NO: 1824 - DNA, 10 bp, Saccharomyces cerevisiae
ctagttttgc

SEQ ID NO: 1825 - DNA, 10 bp, Saccharomyces cerevisiae
ctattataaa

SEQ ID NO: 1826 - DNA, 10 bp, Saccharomyces cerevisiae
ctcattttaa

SEQ ID NO: 1827 - DNA, 10 bp, Saccharomyces cerevisiae
ctgcgaaaag

SEQ ID NO: 1828 - DNA, 10 bp, Saccharomyces cerevisiae
ctgtttctga

SEQ ID NO: 1829 - DNA, 10 bp, Saccharomyces cerevisiae
ctgttttggg

SEQ ID NO: 1830 - DNA, 10 bp, Saccharomyces cerevisiae
cttgcagaag

SEQ ID NO: 1831 - DNA, 10 bp, Saccharomyces cerevisiae
gaaaatagca

SEQ ID NO: 1832 - DNA, 10 bp, Saccharomyces cerevisiae
gaaagtgatg

SEQ ID NO: 1833 - DNA, 10 bp, Saccharomyces cerevisiae
gaacggttgt

SEQ ID NO: 1834 - DNA, 10 bp, Saccharomyces cerevisiae
gaagacctac

SEQ ID NO: 1835 - DNA, 10 bp, Saccharomyces cerevisiae
gaagattgta

SEQ ID NO: 1836 - DNA, 10 bp, Saccharomyces cerevisiae
gaagtggacg

SEQ ID NO: 1837 - DNA, 10 bp, Saccharomyces cerevisiae
gaatactgca

SEQ ID NO: 1838 - DNA, 10 bp, Saccharomyces cerevisiae
gacaagctat

SEQ ID NO: 1839 - DNA, 10 bp, Saccharomyces cerevisiae
gacagtcagt

SEQ ID NO: 1840 - DNA, 10 bp, Saccharomyces cerevisiae
gacccttcct

SEQ ID NO: 1841 - DNA, 10 bp, Saccharomyces cerevisiae
gacgatagtg

SEQ ID NO: 1842 - DNA, 10 bp, Saccharomyces cerevisiae
gagcttttgg

SEQ ID NO: 1843 - DNA, 10 bp, Saccharomyces cerevisiae
gatagtttag

SEQ ID NO: 1844 - DNA, 10 bp, Saccharomyces cerevisiae
gattaagaca

SEQ ID NO: 1845 - DNA, 10 bp, Saccharomyces cerevisiae
gcaaaatagt

SEQ ID NO: 1846 - DNA, 10 bp, Saccharomyces cerevisiae
gcaaagcaaa

SEQ ID NO: 1847 - DNA, 10 bp, Saccharomyces cerevisiae
gcaagtcgca

SEQ ID NO: 1848 - DNA, 10 bp, Saccharomyces cerevisiae
gcataatctg

SEQ ID NO: 1849 - DNA, 10 bp, Saccharomyces cerevisiae
gcatacgctg

SEQ ID NO: 1850 - DNA, 10 bp, Saccharomyces cerevisiae
gccgcatttg

SEQ ID NO: 1851 - DNA, 10 bp, Saccharomyces cerevisiae
gccggctggc

SEQ ID NO: 1852 - DNA, 10 bp, Saccharomyces cerevisiae
gcgtcaagat

SEQ ID NO: 1853 - DNA, 10 bp, Saccharomyces cerevisiae
gctatgaatt

SEQ ID NO: 1854 - DNA, 10 bp, Saccharomyces cerevisiae
gctatgtaca

SEQ ID NO: 1855 - DNA, 10 bp, Saccharomyces cerevisiae
gcttgttttc

SEQ ID NO: 1856 - DNA, 10 bp, Saccharomyces cerevisiae
ggaaaaatac

SEQ ID NO: 1857 - DNA, 10 bp, Saccharomyces cerevisiae
ggaactcagc

SEQ ID NO: 1858 - DNA, 10 bp, Saccharomyces cerevisiae
ggatgcaatc

SEQ ID NO: 1859 - DNA, 10 bp, Saccharomyces cerevisiae
ggatggctcg

SEQ ID NO: 1860 - DNA, 10 bp, Saccharomyces cerevisiae
gggaagaact

SEQ ID NO: 1861 - DNA, 10 bp, Saccharomyces cerevisiae
ggtagtggca

SEQ ID NO: 1862 - DNA, 10 bp, Saccharomyces cerevisiae
ggtctcatcc

SEQ ID NO: 1863 - DNA, 10 bp, Saccharomyces cerevisiae
ggtgctaacg

SEQ ID NO: 1864 - DNA, 10 bp, Saccharomyces cerevisiae
ggtgtcaacg

SEQ ID NO: 1865 - DNA, 10 bp, Saccharomyces cerevisiae
ggtgttaccg

SEQ ID NO: 1866 - DNA, 10 bp, Saccharomyces cerevisiae
ggtgttggta

SEQ ID NO: 1867 - DNA, 10 bp, Saccharomyces cerevisiae
ggtttggaca

SEQ ID NO: 1868 - DNA, 10 bp, Saccharomyces cerevisiae
ggtttggcta

SEQ ID NO: 1869 - DNA, 10 bp, Saccharomyces cerevisiae
ggtttggttt

SEQ ID NO: 1870 - DNA, 10 bp, Saccharomyces cerevisiae
gtaataacga

SEQ ID NO: 1871 - DNA, 10 bp, Saccharomyces cerevisiae
gtacaagggt

SEQ ID NO: 1872 - DNA, 10 bp, Saccharomyces cerevisiae
gtagaccaac

SEQ ID NO: 1873 - DNA, 10 bp, Saccharomyces cerevisiae
gtatcagaaa

SEQ ID NO: 1874 - DNA, 10 bp, Saccharomyces cerevisiae
gtctaccctg

SEQ ID NO: 1875 - DNA, 10 bp, Saccharomyces cerevisiae
gtgattccta

SEQ ID NO: 1876 - DNA, 10 bp, Saccharomyces cerevisiae
gtgatttgtc

SEQ ID NO: 1877 - DNA, 10 bp, Saccharomyces cerevisiae
gtggttaaaa

SEQ ID NO: 1878 - DNA, 10 bp, Saccharomyces cerevisiae
gtgtagagaa

SEQ ID NO: 1879 - DNA, 10 bp, Saccharomyces cerevisiae
gtgtaggata

SEQ ID NO: 1880 - DNA, 10 bp, Saccharomyces cerevisiae
gtgttcgtgt

SEQ ID NO: 1881 - DNA, 10 bp, Saccharomyces cerevisiae
gttgaggaac

SEQ ID NO: 1882 - DNA, 10 bp, Saccharomyces cerevisiae
gttggctgtt

SEQ ID NO: 1883 - DNA, 10 bp, Saccharomyces cerevisiae
taaactattt

SEQ ID NO: 1884 - DNA, 10 bp, Saccharomyces cerevisiae
taaagtgaat

SEQ ID NO: 1885 - DNA, 10 bp, Saccharomyces cerevisiae
taaatagtgc

SEQ ID NO: 1886 - DNA, 10 bp, Saccharomyces cerevisiae
taactttcga

SEQ ID NO: 1887 - DNA, 10 bp, Saccharomyces cerevisiae
taagcccatc

SEQ ID NO: 1888 - DNA, 10 bp, Saccharomyces cerevisiae
tacactcccg

SEQ ID NO: 1889 - DNA, 10 bp, Saccharomyces cerevisiae
taccctatta

SEQ ID NO: 1890 - DNA, 10 bp, Saccharomyces cerevisiae
taccgccctt

SEQ ID NO: 1891 - DNA, 10 bp, Saccharomyces cerevisiae
taccgttaaa

SEQ ID NO: 1892 - DNA, 10 bp, Saccharomyces cerevisiae
tatagagttt

SEQ ID NO: 1893 - DNA, 10 bp, Saccharomyces cerevisiae
tatctcttgt

SEQ ID NO: 1894 - DNA, 10 bp, Saccharomyces cerevisiae
tattggtaga

SEQ ID NO: 1895 - DNA, 10 bp, Saccharomyces cerevisiae
tcaattggag

SEQ ID NO: 1896 - DNA, 10 bp, Saccharomyces cerevisiae
tcaatttgaa

SEQ ID NO: 1897 - DNA, 10 bp, Saccharomyces cerevisiae
tcactttttt

SEQ ID NO: 1898 - DNA, 10 bp, Saccharomyces cerevisiae
tccatagtaa

SEQ ID NO: 1899 - DNA, 10 bp, Saccharomyces cerevisiae
tcccccgtac

SEQ ID NO: 1900 - DNA, 10 bp, Saccharomyces cerevisiae
tcccctacat

SEQ ID NO: 1901 - DNA, 10 bp, Saccharomyces cerevisiae
tcctgattat

SEQ ID NO: 1902 - DNA, 10 bp, Saccharomyces cerevisiae
tctgtgaaac

SEQ ID NO: 1903 - DNA, 10 bp, Saccharomyces cerevisiae
tcttacaata

SEQ ID NO: 1904 - DNA, 10 bp, Saccharomyces cerevisiae
tggatttcag

SEQ ID NO: 1905 - DNA, 10 bp, Saccharomyces cerevisiae
tggcacctca

SEQ ID NO: 1906 - DNA, 10 bp, Saccharomyces cerevisiae
tgggagtcgt

SEQ ID NO: 1907 - DNA, 10 bp, Saccharomyces cerevisiae
tgtacctgta

SEQ ID NO: 1908 - DNA, 10 bp, Saccharomyces cerevisiae
tgttttttac

SEQ ID NO: 1909 - DNA, 10 bp, Saccharomyces cerevisiae
ttaaaacaaa

SEQ ID NO: 1910 - DNA, 10 bp, Saccharomyces cerevisiae
ttaacacaga

SEQ ID NO: 1911 - DNA, 10 bp, Saccharomyces cerevisiae
ttaatgacac

SEQ ID NO: 1912 - DNA, 10 bp, Saccharomyces cerevisiae
ttagttttgg

SEQ ID NO: 1913 - DNA, 10 bp, Saccharomyces cerevisiae
ttatgtagat

SEQ ID NO: 1914 - DNA, 10 bp, Saccharomyces cerevisiae
ttatttcgtt

SEQ ID NO: 1915 - DNA, 10 bp, Saccharomyces cerevisiae
ttcccaccgt

SEQ ID NO: 1916 - DNA, 10 bp, Saccharomyces cerevisiae
ttctattagg

SEQ ID NO: 1917 - DNA, 10 bp, Saccharomyces cerevisiae
ttgaaaaaaa

SEQ ID NO: 1918 - DNA, 10 bp, Saccharomyces cerevisiae
ttgaaaagat

SEQ ID NO: 1919 - DNA, 10 bp, Saccharomyces cerevisiae
ttgaaaattt

SEQ ID NO: 1920 - DNA, 10 bp, Saccharomyces cerevisiae
ttgccagtcc

SEQ ID NO: 1921 - DNA, 10 bp, Saccharomyces cerevisiae
ttgctggaag

SEQ ID NO: 1922 - DNA, 10 bp, Saccharomyces cerevisiae
ttggtatgat

SEQ ID NO: 1923 - DNA, 10 bp, Saccharomyces cerevisiae
ttgtctttcc

SEQ ID NO: 1924 - DNA, 10 bp, Saccharomyces cerevisiae
ttgtgcccat

SEQ ID NO: 1925 - DNA, 10 bp, Saccharomyces cerevisiae
ttttctagaa

SEQ ID NO: 1926 - DNA, 10 bp, Saccharomyces cerevisiae
tttttgatga

SEQ ID NO: 1927 - DNA, 10 bp, Saccharomyces cerevisiae
aaaaaggcgt

SEQ ID NO: 1928 - DNA, 10 bp, Saccharomyces cerevisiae
aaaacgtaac

SEQ ID NO: 1929 - DNA, 10 bp, Saccharomyces cerevisiae
aaaagtttaa

SEQ ID NO: 1930 - DNA, 10 bp, Saccharomyces cerevisiae
aaaatgcaaa

SEQ ID NO: 1931 - DNA, 10 bp, Saccharomyces cerevisiae
aaagaagatg

SEQ ID NO: 1932 - DNA, 10 bp, Saccharomyces cerevisiae
aaagatggga

SEQ ID NO: 1933 - DNA, 10 bp, Saccharomyces cerevisiae
aaattagata

SEQ ID NO: 1934 - DNA, 10 bp, Saccharomyces cerevisiae
aacaaattga

SEQ ID NO: 1935 - DNA, 10 bp, Saccharomyces cerevisiae
aacaacaaca

SEQ ID NO: 1936 - DNA, 10 bp, Saccharomyces cerevisiae
aacggccaaa

SEQ ID NO: 1937 - DNA, 10 bp, Saccharomyces cerevisiae
aacggccaga

SEQ ID NO: 1938 - DNA, 10 bp, Saccharomyces cerevisiae
aacgtaacta

SEQ ID NO: 1939 - DNA, 10 bp, Saccharomyces cerevisiae
aacttttggc

SEQ ID NO: 1940 - DNA, 10 bp, Saccharomyces cerevisiae
aagaaaggat

SEQ ID NO: 1941 - DNA, 10 bp, Saccharomyces cerevisiae
aagaccaaga

SEQ ID NO: 1942 - DNA, 10 bp, Saccharomyces cerevisiae
aagactgtcg

SEQ ID NO: 1943 - DNA, 10 bp, Saccharomyces cerevisiae
aagcgatgag

SEQ ID NO: 1944 - DNA, 10 bp, Saccharomyces cerevisiae
aaggcagggt

SEQ ID NO: 1945 - DNA, 10 bp, Saccharomyces cerevisiae
aaggtgccag

SEQ ID NO: 1946 - DNA, 10 bp, Saccharomyces cerevisiae
aagtgcaaaa

SEQ ID NO: 1947 - DNA, 10 bp, Saccharomyces cerevisiae
aagtgttgcg

SEQ ID NO: 1948 - DNA, 10 bp, Saccharomyces cerevisiae
aatatgccgc

SEQ ID NO: 1949 - DNA, 10 bp, Saccharomyces cerevisiae
aatctcaaaa

SEQ ID NO: 1950 - DNA, 10 bp, Saccharomyces cerevisiae
aatgacactt

SEQ ID NO: 1951 - DNA, 10 bp, Saccharomyces cerevisiae
aatgtgtaat

SEQ ID NO: 1952 - DNA, 10 bp, Saccharomyces cerevisiae
aattagacta

SEQ ID NO: 1953 - DNA, 10 bp, Saccharomyces cerevisiae
acaaataact

SEQ ID NO: 1954 - DNA, 10 bp, Saccharomyces cerevisiae
acaagaaagt

SEQ ID NO: 1955 - DNA, 10 bp, Saccharomyces cerevisiae
acaagattta

SEQ ID NO: 1956 - DNA, 10 bp, Saccharomyces cerevisiae
acactatttc

SEQ ID NO: 1957 - DNA, 10 bp, Saccharomyces cerevisiae
acagcaaacg

SEQ ID NO: 1958 - DNA, 10 bp, Saccharomyces cerevisiae
accacccctg

SEQ ID NO: 1959 - DNA, 10 bp, Saccharomyces cerevisiae
accagattga

SEQ ID NO: 1960 - DNA, 10 bp, Saccharomyces cerevisiae
acccggcttc

SEQ ID NO: 1961 - DNA, 10 bp, Saccharomyces cerevisiae
acccttcgaa

SEQ ID NO: 1962 - DNA, 10 bp, Saccharomyces cerevisiae
acctgaggtc

SEQ ID NO: 1963 - DNA, 10 bp, Saccharomyces cerevisiae
accttcattt

SEQ ID NO: 1964 - DNA, 10 bp, Saccharomyces cerevisiae
acgaaactgt

SEQ ID NO: 1965 - DNA, 10 bp, Saccharomyces cerevisiae
acgaaagaaa

SEQ ID NO: 1966 - DNA, 10 bp, Saccharomyces cerevisiae
acgaacattg

SEQ ID NO: 1967 - DNA, 10 bp, Saccharomyces cerevisiae
acgactcatt

SEQ ID NO: 1968 - DNA, 10 bp, Saccharomyces cerevisiae
acgtctagtt

SEQ ID NO: 1969 - DNA, 10 bp, Saccharomyces cerevisiae
acgttatagt

SEQ ID NO: 1970 - DNA, 10 bp, Saccharomyces cerevisiae
actgacattt

SEQ ID NO: 1971 - DNA, 10 bp, Saccharomyces cerevisiae
actttttcag

SEQ ID NO: 1972 - DNA, 10 bp, Saccharomyces cerevisiae
agatatatgt

SEQ ID NO: 1973 - DNA, 10 bp, Saccharomyces cerevisiae
agcataaata

SEQ ID NO: 1974 - DNA, 10 bp, Saccharomyces cerevisiae
agcgagaata

SEQ ID NO: 1975 - DNA, 10 bp, Saccharomyces cerevisiae
aggacttgga

SEQ ID NO: 1976 - DNA, 10 bp, Saccharomyces cerevisiae
aggatgatcg

SEQ ID NO: 1977 - DNA, 10 bp, Saccharomyces cerevisiae
aggatgatgg

SEQ ID NO: 1978 - DNA, 10 bp, Saccharomyces cerevisiae
aggatggatc

SEQ ID NO: 1979 - DNA, 10 bp, Saccharomyces cerevisiae
agggctttgg

SEQ ID NO: 1980 - DNA, 10 bp, Saccharomyces cerevisiae
agtgactctt

SEQ ID NO: 1981 - DNA, 10 bp, Saccharomyces cerevisiae
agtgccaaca

SEQ ID NO: 1982 - DNA, 10 bp, Saccharomyces cerevisiae
ataattcatc

SEQ ID NO: 1983 - DNA, 10 bp, Saccharomyces cerevisiae
atatatttag

SEQ ID NO: 1984 - DNA, 10 bp, Saccharomyces cerevisiae
atcaaaaaaa

SEQ ID NO: 1985 - DNA, 10 bp, Saccharomyces cerevisiae
atcatcttca

SEQ ID NO: 1986 - DNA, 10 bp, Saccharomyces cerevisiae
atctagatcc

SEQ ID NO: 1987 - DNA, 10 bp, Saccharomyces cerevisiae
atgacccaaa

SEQ ID NO: 1988 - DNA, 10 bp, Saccharomyces cerevisiae
atgcccgttc

SEQ ID NO: 1989 - DNA, 10 bp, Saccharomyces cerevisiae
atgcgtttaa

SEQ ID NO: 1990 - DNA, 10 bp, Saccharomyces cerevisiae
atggtagcca

SEQ ID NO: 1991 - DNA, 10 bp, Saccharomyces cerevisiae
atggtggcgt

SEQ ID NO: 1992 - DNA, 10 bp, Saccharomyces cerevisiae
atgtgtgatt

SEQ ID NO: 1993 - DNA, 10 bp, Saccharomyces cerevisiae
attaccttcg

SEQ ID NO: 1994 - DNA, 10 bp, Saccharomyces cerevisiae
attcctgctg

SEQ ID NO: 1995 - DNA, 10 bp, Saccharomyces cerevisiae
attcgtccaa

SEQ ID NO: 1996 - DNA, 10 bp, Saccharomyces cerevisiae
atttacaacg

SEQ ID NO: 1997 - DNA, 10 bp, Saccharomyces cerevisiae
atttgtaaac

SEQ ID NO: 1998 - DNA, 10 bp, Saccharomyces cerevisiae
atttttgctg

SEQ ID NO: 1999 - DNA, 10 bp, Saccharomyces cerevisiae
caaaaagttg

SEQ ID NO: 2000 - DNA, 10 bp, Saccharomyces cerevisiae
caaagatggc

SEQ ID NO: 2001 - DNA, 10 bp, Saccharomyces cerevisiae
caacaaagtg

SEQ ID NO: 2002 - DNA, 10 bp, Saccharomyces cerevisiae
caacaaggta

SEQ ID NO: 2003 - DNA, 10 bp, Saccharomyces cerevisiae
caacatcacc

SEQ ID NO: 2004 - DNA, 10 bp, Saccharomyces cerevisiae
caactggacc

SEQ ID NO: 2005 - DNA, 10 bp, Saccharomyces cerevisiae
caacttgtga

SEQ ID NO: 2006 - DNA, 10 bp, Saccharomyces cerevisiae
caagagaagt

SEQ ID NO: 2007 - DNA, 10 bp, Saccharomyces cerevisiae
caataaaagc

SEQ ID NO: 2008 - DNA, 10 bp, Saccharomyces cerevisiae
cacacgcaca

SEQ ID NO: 2009 - DNA, 10 bp, Saccharomyces cerevisiae
cactgatggc

SEQ ID NO: 2010 - DNA, 10 bp, Saccharomyces cerevisiae
cagatataaa

SEQ ID NO: 2011 - DNA, 10 bp, Saccharomyces cerevisiae
cagcaattta

SEQ ID NO: 2012 - DNA, 10 bp, Saccharomyces cerevisiae
caggatgaga

SEQ ID NO: 2013 - DNA, 10 bp, Saccharomyces cerevisiae
cataaaatgc

SEQ ID NO: 2014 - DNA, 10 bp, Saccharomyces cerevisiae
catacataaa

SEQ ID NO: 2015 - DNA, 10 bp, Saccharomyces cerevisiae
catactcctc

SEQ ID NO: 2016 - DNA, 10 bp, Saccharomyces cerevisiae
catactggcg

SEQ ID NO: 2017 - DNA, 10 bp, Saccharomyces cerevisiae
cattcaaacc

SEQ ID NO: 2018 - DNA, 10 bp, Saccharomyces cerevisiae
cattcaagtg

SEQ ID NO: 2019 - DNA, 10 bp, Saccharomyces cerevisiae
ccaaaatgct

SEQ ID NO: 2020 - DNA, 10 bp, Saccharomyces cerevisiae
ccaaatatct

SEQ ID NO: 2021 - DNA, 10 bp, Saccharomyces cerevisiae
ccaagagtgg

SEQ ID NO: 2022 - DNA, 10 bp, Saccharomyces cerevisiae
ccacctaatg

SEQ ID NO: 2023 - DNA, 10 bp, Saccharomyces cerevisiae
ccactgtata

SEQ ID NO: 2024 - DNA, 10 bp, Saccharomyces cerevisiae
ccaggtcgta

SEQ ID NO: 2025 - DNA, 10 bp, Saccharomyces cerevisiae
ccagttacat

SEQ ID NO: 2026 - DNA, 10 bp, Saccharomyces cerevisiae
cccataagaa

SEQ ID NO: 2027 - DNA, 10 bp, Saccharomyces cerevisiae
ccccctaatg

SEQ ID NO: 2028 - DNA, 10 bp, Saccharomyces cerevisiae
cccctattaa

SEQ ID NO: 2029 - DNA, 10 bp, Saccharomyces cerevisiae
cccttccctt

SEQ ID NO: 2030 - DNA, 10 bp, Saccharomyces cerevisiae
ccgtttagga

SEQ ID NO: 2031 - DNA, 10 bp, Saccharomyces cerevisiae
cctaaagttt

SEQ ID NO: 2032 - DNA, 10 bp, Saccharomyces cerevisiae
cgaaatcgag

SEQ ID NO: 2033 - DNA, 10 bp, Saccharomyces cerevisiae
cgtcaacaac

SEQ ID NO: 2034 - DNA, 10 bp, Saccharomyces cerevisiae
ctacacaggt

SEQ ID NO: 2035 - DNA, 10 bp, Saccharomyces cerevisiae
ctatagaacc

SEQ ID NO: 2036 - DNA, 10 bp, Saccharomyces cerevisiae
ctatccaaca

SEQ ID NO: 2037 - DNA, 10 bp, Saccharomyces cerevisiae
ctcagaaaag

SEQ ID NO: 2038 - DNA, 10 bp, Saccharomyces cerevisiae
ctgcttttgt

SEQ ID NO: 2039 - DNA, 10 bp, Saccharomyces cerevisiae
cttaatgccg

SEQ ID NO: 2040 - DNA, 10 bp, Saccharomyces cerevisiae
cttttatact

SEQ ID NO: 2041 - DNA, 10 bp, Saccharomyces cerevisiae
cttttctgct

SEQ ID NO: 2042 - DNA, 10 bp, Saccharomyces cerevisiae
gaaaaagggt

SEQ ID NO: 2043 - DNA, 10 bp, Saccharomyces cerevisiae
gaaaattaac

SEQ ID NO: 2044 - DNA, 10 bp, Saccharomyces cerevisiae
gaaacaaagg

SEQ ID NO: 2045 - DNA, 10 bp, Saccharomyces cerevisiae
gaaacggtgt

SEQ ID NO: 2046 - DNA, 10 bp, Saccharomyces cerevisiae
gaagaacgtc

SEQ ID NO: 2047 - DNA, 10 bp, Saccharomyces cerevisiae
gaataataga

SEQ ID NO: 2048 - DNA, 10 bp, Saccharomyces cerevisiae
gaatggaatc

SEQ ID NO: 2049 - DNA, 10 bp, Saccharomyces cerevisiae
gacaaagttg

SEQ ID NO: 2050 - DNA, 10 bp, Saccharomyces cerevisiae
gactttttgg

SEQ ID NO: 2051 - DNA, 10 bp, Saccharomyces cerevisiae
gataatgaca

SEQ ID NO: 2052 - DNA, 10 bp, Saccharomyces cerevisiae
gatactacgg

SEQ ID NO: 2053 - DNA, 10 bp, Saccharomyces cerevisiae
gatatgctat

SEQ ID NO: 2054 - DNA, 10 bp, Saccharomyces cerevisiae
gatccagtag

SEQ ID NO: 2055 - DNA, 10 bp, Saccharomyces cerevisiae
gatccatttt

SEQ ID NO: 2056 - DNA, 10 bp, Saccharomyces cerevisiae
gcaaaaacta

SEQ ID NO: 2057 - DNA, 10 bp, Saccharomyces cerevisiae
gcaagatctt

SEQ ID NO: 2058 - DNA, 10 bp, Saccharomyces cerevisiae
gcaaggtgca

SEQ ID NO: 2059 - DNA, 10 bp, Saccharomyces cerevisiae
gcaagttcct

SEQ ID NO: 2060 - DNA, 10 bp, Saccharomyces cerevisiae
gcagttcaat

SEQ ID NO: 2061 - DNA, 10 bp, Saccharomyces cerevisiae
gccaaaatct

SEQ ID NO: 2062 - DNA, 10 bp, Saccharomyces cerevisiae
gcccgcacta

SEQ ID NO: 2063 - DNA, 10 bp, Saccharomyces cerevisiae
gccggttttc

SEQ ID NO: 2064 - DNA, 10 bp, Saccharomyces cerevisiae
gccgtcgcgg

SEQ ID NO: 2065 - DNA, 10 bp, Saccharomyces cerevisiae
gcgaaccgat

SEQ ID NO: 2066 - DNA, 10 bp, Saccharomyces cerevisiae
gcggcagaat

SEQ ID NO: 2067 - DNA, 10 bp, Saccharomyces cerevisiae
gcggtggttt

SEQ ID NO: 2068 - DNA, 10 bp, Saccharomyces cerevisiae
gctagaaaca

SEQ ID NO: 2069 - DNA, 10 bp, Saccharomyces cerevisiae
gctgatcaag

SEQ ID NO: 2070 - DNA, 10 bp, Saccharomyces cerevisiae
gcttggatgg

SEQ ID NO: 2071 - DNA, 10 bp, Saccharomyces cerevisiae
ggacaaactg

SEQ ID NO: 2072 - DNA, 10 bp, Saccharomyces cerevisiae
ggacagagct

SEQ ID NO: 2073 - DNA, 10 bp, Saccharomyces cerevisiae
ggactataag

SEQ ID NO: 2074 - DNA, 10 bp, Saccharomyces cerevisiae
ggatatggca

SEQ ID NO: 2075 - DNA, 10 bp, Saccharomyces cerevisiae
ggccttggcg

SEQ ID NO: 2076 - DNA, 10 bp, Saccharomyces cerevisiae
ggcgaaaacg

SEQ ID NO: 2077 - DNA, 10 bp, Saccharomyces cerevisiae
ggctctagtt

SEQ ID NO: 2078 - DNA, 10 bp, Saccharomyces cerevisiae
ggcttgcttt

SEQ ID NO: 2079 - DNA, 10 bp, Saccharomyces cerevisiae
gggagcctta

SEQ ID NO: 2080 - DNA, 10 bp, Saccharomyces cerevisiae
gggctcttga

SEQ ID NO: 2081 - DNA, 10 bp, Saccharomyces cerevisiae
ggggcatata

SEQ ID NO: 2082 - DNA, 10 bp, Saccharomyces cerevisiae
ggtaacacgc

SEQ ID NO: 2083 - DNA, 10 bp, Saccharomyces cerevisiae
ggtgtaacga

SEQ ID NO: 2084 - DNA, 10 bp, Saccharomyces cerevisiae
gtaatttttg

SEQ ID NO: 2085 - DNA, 10 bp, Saccharomyces cerevisiae
gtacaaagag

SEQ ID NO: 2086 - DNA, 10 bp, Saccharomyces cerevisiae
gtagcgcctg

SEQ ID NO: 2087 - DNA, 10 bp, Saccharomyces cerevisiae
gtattcctga

SEQ ID NO: 2088 - DNA, 10 bp, Saccharomyces cerevisiae
gtcatatagt

SEQ ID NO: 2089 - DNA, 10 bp, Saccharomyces cerevisiae
gtcccacata

SEQ ID NO: 2090 - DNA, 10 bp, Saccharomyces cerevisiae
gtctggcggc

SEQ ID NO: 2091 - DNA, 10 bp, Saccharomyces cerevisiae
gtgactttgc

SEQ ID NO: 2092 - DNA, 10 bp, Saccharomyces cerevisiae
gtggagctgt

SEQ ID NO: 2093 - DNA, 10 bp, Saccharomyces cerevisiae
gtgggaaagg

SEQ ID NO: 2094 - DNA, 10 bp, Saccharomyces cerevisiae
gtggtgcttt

SEQ ID NO: 2095 - DNA, 10 bp, Saccharomyces cerevisiae
gtgtcattta

SEQ ID NO: 2096 - DNA, 10 bp, Saccharomyces cerevisiae
gtgtgacgat

SEQ ID NO: 2097 - DNA, 10 bp, Saccharomyces cerevisiae
gttattcact

SEQ ID NO: 2098 - DNA, 10 bp, Saccharomyces cerevisiae
gttgaagcag

SEQ ID NO: 2099 - DNA, 10 bp, Saccharomyces cerevisiae
gtttgattat

SEQ ID NO: 2100 - DNA, 10 bp, Saccharomyces cerevisiae
gtttttgttt

SEQ ID NO: 2101 - DNA, 10 bp, Saccharomyces cerevisiae
taaactaata

SEQ ID NO: 2102 - DNA, 10 bp, Saccharomyces cerevisiae
taagactttt

SEQ ID NO: 2103 - DNA, 10 bp, Saccharomyces cerevisiae
taatttactt

SEQ ID NO: 2104 - DNA, 10 bp, Saccharomyces cerevisiae
tacaaataat

SEQ ID NO: 2105 - DNA, 10 bp, Saccharomyces cerevisiae
taccactccc

SEQ ID NO: 2106 - DNA, 10 bp, Saccharomyces cerevisiae
tacgagaata

SEQ ID NO: 2107 - DNA, 10 bp, Saccharomyces cerevisiae
tactttatat

SEQ ID NO: 2108 - DNA, 10 bp, Saccharomyces cerevisiae
tagcggtaaa

SEQ ID NO: 2109 - DNA, 10 bp, Saccharomyces cerevisiae
taggcggaca

SEQ ID NO: 2110 - DNA, 10 bp, Saccharomyces cerevisiae
tataataact

SEQ ID NO: 2111 - DNA, 10 bp, Saccharomyces cerevisiae
tatacacaca

SEQ ID NO: 2112 - DNA, 10 bp, Saccharomyces cerevisiae
tatactagga

SEQ ID NO: 2113 - DNA, 10 bp, Saccharomyces cerevisiae
tataggtcaa

SEQ ID NO: 2114 - DNA, 10 bp, Saccharomyces cerevisiae
tatatatttg

SEQ ID NO: 2115 - DNA, 10 bp, Saccharomyces cerevisiae
tatatgccta

SEQ ID NO: 2116 - DNA, 10 bp, Saccharomyces cerevisiae
tatatgtatt

SEQ ID NO: 2117 - DNA, 10 bp, Saccharomyces cerevisiae
tatccataca

SEQ ID NO: 2118 - DNA, 10 bp, Saccharomyces cerevisiae
tatctacaat

SEQ ID NO: 2119 - DNA, 10 bp, Saccharomyces cerevisiae
tatctagttt

SEQ ID NO: 2120 - DNA, 10 bp, Saccharomyces cerevisiae
tatctatcta

SEQ ID NO: 2121 - DNA, 10 bp, Saccharomyces cerevisiae
tatgaaacgt

SEQ ID NO: 2122 - DNA, 10 bp, Saccharomyces cerevisiae
tattgaatgc

SEQ ID NO: 2123 - DNA, 10 bp, Saccharomyces cerevisiae
tattgggaaa

SEQ ID NO: 2124 - DNA, 10 bp, Saccharomyces cerevisiae
tcaattcttg

SEQ ID NO: 2125 - DNA, 10 bp, Saccharomyces cerevisiae
tccccgtacg

SEQ ID NO: 2126 - DNA, 10 bp, Saccharomyces cerevisiae
tccctattag

SEQ ID NO: 2127 - DNA, 10 bp, Saccharomyces cerevisiae
tccttgtact

SEQ ID NO: 2128 - DNA, 10 bp, Saccharomyces cerevisiae
tcgaccacac

SEQ ID NO: 2129 - DNA, 10 bp, Saccharomyces cerevisiae
tctgaatctt

SEQ ID NO: 2130 - DNA, 10 bp, Saccharomyces cerevisiae
tctgatatct

SEQ ID NO: 2131 - DNA, 10 bp, Saccharomyces cerevisiae
tgaatggaca

SEQ ID NO: 2132 - DNA, 10 bp, Saccharomyces cerevisiae
tgaggcttgc

SEQ ID NO: 2133 - DNA, 10 bp, Saccharomyces cerevisiae
tgatgaagat

SEQ ID NO: 2134 - DNA, 10 bp, Saccharomyces cerevisiae
tgcggtttta

SEQ ID NO: 2135 - DNA, 10 bp, Saccharomyces cerevisiae
tgctgcatac

SEQ ID NO: 2136 - DNA, 10 bp, Saccharomyces cerevisiae
tgctttgatt

SEQ ID NO: 2137 - DNA, 10 bp, Saccharomyces cerevisiae
tggtatccta

SEQ ID NO: 2138 - DNA, 10 bp, Saccharomyces cerevisiae
tggtcatcaa

SEQ ID NO: 2139 - DNA, 10 bp, Saccharomyces cerevisiae
tgtatacgtg

SEQ ID NO: 2140 - DNA, 10 bp, Saccharomyces cerevisiae
tgtatgacta

SEQ ID NO: 2141 - DNA, 10 bp, Saccharomyces cerevisiae
tgtgctaagc

SEQ ID NO: 2142 - DNA, 10 bp, Saccharomyces cerevisiae
tgtttttatg

SEQ ID NO: 2143 - DNA, 10 bp, Saccharomyces cerevisiae
ttacaattta

SEQ ID NO: 2144 - DNA, 10 bp, Saccharomyces cerevisiae
ttactttgac

SEQ ID NO: 2145 - DNA, 10 bp, Saccharomyces cerevisiae
ttatgttctc

SEQ ID NO: 2146 - DNA, 10 bp, Saccharomyces cerevisiae
ttctatctaa

SEQ ID NO: 2147 - DNA, 10 bp, Saccharomyces cerevisiae
ttgaaaacta

SEQ ID NO: 2148 - DNA, 10 bp, Saccharomyces cerevisiae
ttgagttgaa

SEQ ID NO: 2149 - DNA, 10 bp, Saccharomyces cerevisiae
ttgcaataaa

SEQ ID NO: 2150 - DNA, 10 bp, Saccharomyces cerevisiae
ttggtggtca

SEQ ID NO: 2151 - DNA, 10 bp, Saccharomyces cerevisiae
ttgtggatga

SEQ ID NO: 2152 - DNA, 10 bp, Saccharomyces cerevisiae
tttaatactg

SEQ ID NO: 2153 - DNA, 10 bp, Saccharomyces cerevisiae
tttagttaat

SEQ ID NO: 2154 - DNA, 10 bp, Saccharomyces cerevisiae
tttttctatc

SEQ ID NO: 2155 - DNA, 10 bp, Saccharomyces cerevisiae
aaaaatgagg

SEQ ID NO: 2156 - DNA, 10 bp, Saccharomyces cerevisiae
aaaacataaa

SEQ ID NO: 2157 - DNA, 10 bp, Saccharomyces cerevisiae
aaaatgaaga

SEQ ID NO: 2158 - DNA, 10 bp, Saccharomyces cerevisiae
aaaatgatca

SEQ ID NO: 2159 - DNA, 10 bp, Saccharomyces cerevisiae
aaaatgttgg

SEQ ID NO: 2160 - DNA, 10 bp, Saccharomyces cerevisiae
aaaattcttt

SEQ ID NO: 2161 - DNA, 10 bp, Saccharomyces cerevisiae
aaaccagctg

SEQ ID NO: 2162 - DNA, 10 bp, Saccharomyces cerevisiae
aaaccgtccc

SEQ ID NO: 2163 - DNA, 10 bp, Saccharomyces cerevisiae
aaacctgtga

SEQ ID NO: 2164 - DNA, 10 bp, Saccharomyces cerevisiae
aaacgcgaca

SEQ ID NO: 2165 - DNA, 10 bp, Saccharomyces cerevisiae
aaactatgat

SEQ ID NO: 2166 - DNA, 10 bp, Saccharomyces cerevisiae
aaactttcaa

SEQ ID NO: 2167 - DNA, 10 bp, Saccharomyces cerevisiae
aaagttttct

SEQ ID NO: 2168 - DNA, 10 bp, Saccharomyces cerevisiae
aaataattaa

SEQ ID NO: 2169 - DNA, 10 bp, Saccharomyces cerevisiae
aaatggtgat

SEQ ID NO: 2170 - DNA, 10 bp, Saccharomyces cerevisiae
aaattccccg

SEQ ID NO: 2171 - DNA, 10 bp, Saccharomyces cerevisiae
aaattgagat

SEQ ID NO: 2172 - DNA, 10 bp, Saccharomyces cerevisiae
aacacaataa

SEQ ID NO: 2173 - DNA, 10 bp, Saccharomyces cerevisiae
aacagaccaa

SEQ ID NO: 2174 - DNA, 10 bp, Saccharomyces cerevisiae
aaccagctaa

SEQ ID NO: 2175 - DNA, 10 bp, Saccharomyces cerevisiae
aacgacgagg

SEQ ID NO: 2176 - DNA, 10 bp, Saccharomyces cerevisiae
aacgagttat

SEQ ID NO: 2177 - DNA, 10 bp, Saccharomyces cerevisiae
aacgtcaagc

SEQ ID NO: 2178 - DNA, 10 bp, Saccharomyces cerevisiae
aacttactgt

SEQ ID NO: 2179 - DNA, 10 bp, Saccharomyces cerevisiae
aagaaggcga

SEQ ID NO: 2180 - DNA, 10 bp, Saccharomyces cerevisiae
aagaggagaa

SEQ ID NO: 2181 - DNA, 10 bp, Saccharomyces cerevisiae
aagaggtcaa

SEQ ID NO: 2182 - DNA, 10 bp, Saccharomyces cerevisiae
aagccaggca

SEQ ID NO: 2183 - DNA, 10 bp, Saccharomyces cerevisiae
aaggataaag

SEQ ID NO: 2184 - DNA, 10 bp, Saccharomyces cerevisiae
aagggcaaag

SEQ ID NO: 2185 - DNA, 10 bp, Saccharomyces cerevisiae
aagtactcta

SEQ ID NO: 2186 - DNA, 10 bp, Saccharomyces cerevisiae
aataatagtt

SEQ ID NO: 2187 - DNA, 10 bp, Saccharomyces cerevisiae
aataccagcg

SEQ ID NO: 2188 - DNA, 10 bp, Saccharomyces cerevisiae
aataccatca

SEQ ID NO: 2189 - DNA, 10 bp, Saccharomyces cerevisiae
aatggagcgt

SEQ ID NO: 2190 - DNA, 10 bp, Saccharomyces cerevisiae
aattaatgca

SEQ ID NO: 2191 - DNA, 10 bp, Saccharomyces cerevisiae
aattacagaa

SEQ ID NO: 2192 - DNA, 10 bp, Saccharomyces cerevisiae
acaacagtat

SEQ ID NO: 2193 - DNA, 10 bp, Saccharomyces cerevisiae
acaagattgt

SEQ ID NO: 2194 - DNA, 10 bp, Saccharomyces cerevisiae
acaggccagc

SEQ ID NO: 2195 - DNA, 10 bp, Saccharomyces cerevisiae
acaggtgtca

SEQ ID NO: 2196 - DNA, 10 bp, Saccharomyces cerevisiae
acataggcca

SEQ ID NO: 2197 - DNA, 10 bp, Saccharomyces cerevisiae
acatcccctt

SEQ ID NO: 2198 - DNA, 10 bp, Saccharomyces cerevisiae
acatctcatt

SEQ ID NO: 2199 - DNA, 10 bp, Saccharomyces cerevisiae
accatttagt

SEQ ID NO: 2200 - DNA, 10 bp, Saccharomyces cerevisiae
accccagtcc

SEQ ID NO: 2201 - DNA, 10 bp, Saccharomyces cerevisiae
acctccattt

SEQ ID NO: 2202 - DNA, 10 bp, Saccharomyces cerevisiae
acgagatgcg

SEQ ID NO: 2203 - DNA, 10 bp, Saccharomyces cerevisiae
acgagctttg

SEQ ID NO: 2204 - DNA, 10 bp, Saccharomyces cerevisiae
acgatctggc

SEQ ID NO: 2205 - DNA, 10 bp, Saccharomyces cerevisiae
actctaagat

SEQ ID NO: 2206 - DNA, 10 bp, Saccharomyces cerevisiae
acttcgtctt

SEQ ID NO: 2207 - DNA, 10 bp, Saccharomyces cerevisiae
acttgacagc

SEQ ID NO: 2208 - DNA, 10 bp, Saccharomyces cerevisiae
acttgcggta

SEQ ID NO: 2209 - DNA, 10 bp, Saccharomyces cerevisiae
actttatggg

SEQ ID NO: 2210 - DNA, 10 bp, Saccharomyces cerevisiae
agaaaaaaca

SEQ ID NO: 2211 - DNA, 10 bp, Saccharomyces cerevisiae
agaacatcaa

SEQ ID NO: 2212 - DNA, 10 bp, Saccharomyces cerevisiae
agaacgtgcg

SEQ ID NO: 2213 - DNA, 10 bp, Saccharomyces cerevisiae
agaagctgaa

SEQ ID NO: 2214 - DNA, 10 bp, Saccharomyces cerevisiae
agacaaacta

SEQ ID NO: 2215 - DNA, 10 bp, Saccharomyces cerevisiae
agacagactg

SEQ ID NO: 2216 - DNA, 10 bp, Saccharomyces cerevisiae
agattaagat

SEQ ID NO: 2217 - DNA, 10 bp, Saccharomyces cerevisiae
agattcgaag

SEQ ID NO: 2218 - DNA, 10 bp, Saccharomyces cerevisiae
agcactatgt

SEQ ID NO: 2219 - DNA, 10 bp, Saccharomyces cerevisiae
agcaggggaa

SEQ ID NO: 2220 - DNA, 10 bp, Saccharomyces cerevisiae
aggaaagaat

SEQ ID NO: 2221 - DNA, 10 bp, Saccharomyces cerevisiae
aggagagaga

SEQ ID NO: 2222 - DNA, 10 bp, Saccharomyces cerevisiae
aggcaaactg

SEQ ID NO: 2223 - DNA, 10 bp, Saccharomyces cerevisiae
aggtcaacgg

SEQ ID NO: 2224 - DNA, 10 bp, Saccharomyces cerevisiae
aggttgatgg

SEQ ID NO: 2225 - DNA, 10 bp, Saccharomyces cerevisiae
agtgaaaaaa

SEQ ID NO: 2226 - DNA, 10 bp, Saccharomyces cerevisiae
agtggatggt

SEQ ID NO: 2227 - DNA, 10 bp, Saccharomyces cerevisiae
agttcttctt

SEQ ID NO: 2228 - DNA, 10 bp, Saccharomyces cerevisiae
ataccagcct

SEQ ID NO: 2229 - DNA, 10 bp, Saccharomyces cerevisiae
atagcaattg

SEQ ID NO: 2230 - DNA, 10 bp, Saccharomyces cerevisiae
atcacacagt

SEQ ID NO: 2231 - DNA, 10 bp, Saccharomyces cerevisiae
atcatttggg

SEQ ID NO: 2232 - DNA, 10 bp, Saccharomyces cerevisiae
atcgcatatt

SEQ ID NO: 2233 - DNA, 10 bp, Saccharomyces cerevisiae
atcggtactt

SEQ ID NO: 2234 - DNA, 10 bp, Saccharomyces cerevisiae
atctcttacc

SEQ ID NO: 2235 - DNA, 10 bp, Saccharomyces cerevisiae
atcttgagct

SEQ ID NO: 2236 - DNA, 10 bp, Saccharomyces cerevisiae
atcttttcat

SEQ ID NO: 2237 - DNA, 10 bp, Saccharomyces cerevisiae
atgagtttat

SEQ ID NO: 2238 - DNA, 10 bp, Saccharomyces cerevisiae
atggagccaa

SEQ ID NO: 2239 - DNA, 10 bp, Saccharomyces cerevisiae
atggatatgc

SEQ ID NO: 2240 - DNA, 10 bp, Saccharomyces cerevisiae
atggcacgtt

SEQ ID NO: 2241 - DNA, 10 bp, Saccharomyces cerevisiae
attatggcgt

SEQ ID NO: 2242 - DNA, 10 bp, Saccharomyces cerevisiae
attatttctc

SEQ ID NO: 2243 - DNA, 10 bp, Saccharomyces cerevisiae
attgagaagg

SEQ ID NO: 2244 - DNA, 10 bp, Saccharomyces cerevisiae
attgcgagag

SEQ ID NO: 2245 - DNA, 10 bp, Saccharomyces cerevisiae
attgtcaagg

SEQ ID NO: 2246 - DNA, 10 bp, Saccharomyces cerevisiae
atttacaatt

SEQ ID NO: 2247 - DNA, 10 bp, Saccharomyces cerevisiae
atttggacaa

SEQ ID NO: 2248 - DNA, 10 bp, Saccharomyces cerevisiae
attttctgtt

SEQ ID NO: 2249 - DNA, 10 bp, Saccharomyces cerevisiae
caaacaagaa

SEQ ID NO: 2250 - DNA, 10 bp, Saccharomyces cerevisiae
caaaggaagc

SEQ ID NO: 2251 - DNA, 10 bp, Saccharomyces cerevisiae
caaatccaaa

SEQ ID NO: 2252 - DNA, 10 bp, Saccharomyces cerevisiae
caactttatt

SEQ ID NO: 2253 - DNA, 10 bp, Saccharomyces cerevisiae
caagattatg

SEQ ID NO: 2254 - DNA, 10 bp, Saccharomyces cerevisiae
caagtgcgca

SEQ ID NO: 2255 - DNA, 10 bp, Saccharomyces cerevisiae
caatccaata

SEQ ID NO: 2256 - DNA, 10 bp, Saccharomyces cerevisiae
caatcgaggc

SEQ ID NO: 2257 - DNA, 10 bp, Saccharomyces cerevisiae
caattcttta

SEQ ID NO: 2258 - DNA, 10 bp, Saccharomyces cerevisiae
caattgggaa

SEQ ID NO: 2259 - DNA, 10 bp, Saccharomyces cerevisiae
caatttcttg

SEQ ID NO: 2260 - DNA, 10 bp, Saccharomyces cerevisiae
cacgcaagtt

SEQ ID NO: 2261 - DNA, 10 bp, Saccharomyces cerevisiae
cacgttaggg

SEQ ID NO: 2262 - DNA, 10 bp, Saccharomyces cerevisiae
cactaaaatt

SEQ ID NO: 2263 - DNA, 10 bp, Saccharomyces cerevisiae
cagaaccatc

SEQ ID NO: 2264 - DNA, 10 bp, Saccharomyces cerevisiae
cagggtaacc

SEQ ID NO: 2265 - DNA, 10 bp, Saccharomyces cerevisiae
cagtatttaa

SEQ ID NO: 2266 - DNA, 10 bp, Saccharomyces cerevisiae
cataaaatgt

SEQ ID NO: 2267 - DNA, 10 bp, Saccharomyces cerevisiae
catcgtaaaa

SEQ ID NO: 2268 - DNA, 10 bp, Saccharomyces cerevisiae
ccaacaatga

SEQ ID NO: 2269 - DNA, 10 bp, Saccharomyces cerevisiae
ccaatggttc

SEQ ID NO: 2270 - DNA, 10 bp, Saccharomyces cerevisiae
ccagaaggag

SEQ ID NO: 2271 - DNA, 10 bp, Saccharomyces cerevisiae
ccatatctgt

SEQ ID NO: 2272 - DNA, 10 bp, Saccharomyces cerevisiae
ccattgatga

SEQ ID NO: 2273 - DNA, 10 bp, Saccharomyces cerevisiae
cccggttact

SEQ ID NO: 2274 - DNA, 10 bp, Saccharomyces cerevisiae
ccctaagact

SEQ ID NO: 2275 - DNA, 10 bp, Saccharomyces cerevisiae
ccgagtgcta

SEQ ID NO: 2276 - DNA, 10 bp, Saccharomyces cerevisiae
ccggcaacac

SEQ ID NO: 2277 - DNA, 10 bp, Saccharomyces cerevisiae
ccggttacta

SEQ ID NO: 2278 - DNA, 10 bp, Saccharomyces cerevisiae
cctgagtcgt

SEQ ID NO: 2279 - DNA, 10 bp, Saccharomyces cerevisiae
ccttacgtct

SEQ ID NO: 2280 - DNA, 10 bp, Saccharomyces cerevisiae
ccttcgttac

SEQ ID NO: 2281 - DNA, 10 bp, Saccharomyces cerevisiae
cctttagact

SEQ ID NO: 2282 - DNA, 10 bp, Saccharomyces cerevisiae
cctttcaaaa

SEQ ID NO: 2283 - DNA, 10 bp, Saccharomyces cerevisiae
cgaagtgatg

SEQ ID NO: 2284 - DNA, 10 bp, Saccharomyces cerevisiae
cgagacttgg

SEQ ID NO: 2285 - DNA, 10 bp, Saccharomyces cerevisiae
cgatcaccaa

SEQ ID NO: 2286 - DNA, 10 bp, Saccharomyces cerevisiae
cgatgagaag

SEQ ID NO: 2287 - DNA, 10 bp, Saccharomyces cerevisiae
cgatgtcatt

SEQ ID NO: 2288 - DNA, 10 bp, Saccharomyces cerevisiae
cggggaatgt

SEQ ID NO: 2289 - DNA, 10 bp, Saccharomyces cerevisiae
cgtttccgca

SEQ ID NO: 2290 - DNA, 10 bp, Saccharomyces cerevisiae
ctagaggttt

SEQ ID NO: 2291 - DNA, 10 bp, Saccharomyces cerevisiae
ctcactgact

SEQ ID NO: 2292 - DNA, 10 bp, Saccharomyces cerevisiae
ctcttctgtt

SEQ ID NO: 2293 - DNA, 10 bp, Saccharomyces cerevisiae
ctgaacttta

SEQ ID NO: 2294 - DNA, 10 bp, Saccharomyces cerevisiae
ctgatagaag

SEQ ID NO: 2295 - DNA, 10 bp, Saccharomyces cerevisiae
ctggaagaga

SEQ ID NO: 2296 - DNA, 10 bp, Saccharomyces cerevisiae
ctggcatttt

SEQ ID NO: 2297 - DNA, 10 bp, Saccharomyces cerevisiae
ctggctcaag

SEQ ID NO: 2298 - DNA, 10 bp, Saccharomyces cerevisiae
ctggtaaatc

SEQ ID NO: 2299 - DNA, 10 bp, Saccharomyces cerevisiae
ctgttctggc

SEQ ID NO: 2300 - DNA, 10 bp, Saccharomyces cerevisiae
cttgagacga

SEQ ID NO: 2301 - DNA, 10 bp, Saccharomyces cerevisiae
cttgataata

SEQ ID NO: 2302 - DNA, 10 bp, Saccharomyces cerevisiae
cttgggctat

SEQ ID NO: 2303 - DNA, 10 bp, Saccharomyces cerevisiae
cttgtggata

SEQ ID NO: 2304 - DNA, 10 bp, Saccharomyces cerevisiae
ctttaccaaa

SEQ ID NO: 2305 - DNA, 10 bp, Saccharomyces cerevisiae
ctttcgaaaa

SEQ ID NO: 2306 - DNA, 10 bp, Saccharomyces cerevisiae
ctttttcaaa

SEQ ID NO: 2307 - DNA, 10 bp, Saccharomyces cerevisiae
gaaaagattt

SEQ ID NO: 2308 - DNA, 10 bp, Saccharomyces cerevisiae
gaaaagtaaa

SEQ ID NO: 2309 - DNA, 10 bp, Saccharomyces cerevisiae
gaaactgaac

SEQ ID NO: 2310 - DNA, 10 bp, Saccharomyces cerevisiae
gaagtgatga

SEQ ID NO: 2311 - DNA, 10 bp, Saccharomyces cerevisiae
gaatccagta

SEQ ID NO: 2312 - DNA, 10 bp, Saccharomyces cerevisiae
gacaagacga

SEQ ID NO: 2313 - DNA, 10 bp, Saccharomyces cerevisiae
gacatttgga

SEQ ID NO: 2314 - DNA, 10 bp, Saccharomyces cerevisiae
gaccgcaatg

SEQ ID NO: 2315 - DNA, 10 bp, Saccharomyces cerevisiae
gacgctgtta

SEQ ID NO: 2316 - DNA, 10 bp, Saccharomyces cerevisiae
gagaacgcaa

SEQ ID NO: 2317 - DNA, 10 bp, Saccharomyces cerevisiae
gagctaagaa

SEQ ID NO: 2318 - DNA, 10 bp, Saccharomyces cerevisiae
gaggctcaaa

SEQ ID NO: 2319 - DNA, 10 bp, Saccharomyces cerevisiae
gatatcttta

SEQ ID NO: 2320 - DNA, 10 bp, Saccharomyces cerevisiae
gatccaatcc

SEQ ID NO: 2321 - DNA, 10 bp, Saccharomyces cerevisiae
gatgacgaat

SEQ ID NO: 2322 - DNA, 10 bp, Saccharomyces cerevisiae
gatgcccttt

SEQ ID NO: 2323 - DNA, 10 bp, Saccharomyces cerevisiae
gattcctaaa

SEQ ID NO: 2324 - DNA, 10 bp, Saccharomyces cerevisiae
gattctcgag

SEQ ID NO: 2325 - DNA, 10 bp, Saccharomyces cerevisiae
gattgaagaa

SEQ ID NO: 2326 - DNA, 10 bp, Saccharomyces cerevisiae
gatttctctg

SEQ ID NO: 2327 - DNA, 10 bp, Saccharomyces cerevisiae
gatttttgtt

SEQ ID NO: 2328 - DNA, 10 bp, Saccharomyces cerevisiae
gattttttac

SEQ ID NO: 2329 - DNA, 10 bp, Saccharomyces cerevisiae
gcagatctcg

SEQ ID NO: 2330 - DNA, 10 bp, Saccharomyces cerevisiae
gccaagaaac

SEQ ID NO: 2331 - DNA, 10 bp, Saccharomyces cerevisiae
gccaatgacc

SEQ ID NO: 2332 - DNA, 10 bp, Saccharomyces cerevisiae
gccactggta

SEQ ID NO: 2333 - DNA, 10 bp, Saccharomyces cerevisiae
gccgttctta

SEQ ID NO: 2334 - DNA, 10 bp, Saccharomyces cerevisiae
gcctcgttta

SEQ ID NO: 2335 - DNA, 10 bp, Saccharomyces cerevisiae
gccttgtata

SEQ ID NO: 2336 - DNA, 10 bp, Saccharomyces cerevisiae
gcgatgtact

SEQ ID NO: 2337 - DNA, 10 bp, Saccharomyces cerevisiae
gcgccttgtt

SEQ ID NO: 2338 - DNA, 10 bp, Saccharomyces cerevisiae
gcggctgctg

SEQ ID NO: 2339 - DNA, 10 bp, Saccharomyces cerevisiae
gcgtgacgaa

SEQ ID NO: 2340 - DNA, 10 bp, Saccharomyces cerevisiae
gctatgtgta

SEQ ID NO: 2341 - DNA, 10 bp, Saccharomyces cerevisiae
gctcctgaag

SEQ ID NO: 2342 - DNA, 10 bp, Saccharomyces cerevisiae
gctgcggtat

SEQ ID NO: 2343 - DNA, 10 bp, Saccharomyces cerevisiae
gctgtgactt

SEQ ID NO: 2344 - DNA, 10 bp, Saccharomyces cerevisiae
gcttgcgtgt

SEQ ID NO: 2345 - DNA, 10 bp, Saccharomyces cerevisiae
ggaatagaca

SEQ ID NO: 2346 - DNA, 10 bp, Saccharomyces cerevisiae
ggacctaagt

SEQ ID NO: 2347 - DNA, 10 bp, Saccharomyces cerevisiae
ggacctgtgg

SEQ ID NO: 2348 - DNA, 10 bp, Saccharomyces cerevisiae
ggagcggtaa

SEQ ID NO: 2349 - DNA, 10 bp, Saccharomyces cerevisiae
ggagtggcag

SEQ ID NO: 2350 - DNA, 10 bp, Saccharomyces cerevisiae
ggatcgtccg

SEQ ID NO: 2351 - DNA, 10 bp, Saccharomyces cerevisiae
ggatcttact

SEQ ID NO: 2352 - DNA, 10 bp, Saccharomyces cerevisiae
ggatttactg

SEQ ID NO: 2353 - DNA, 10 bp, Saccharomyces cerevisiae
ggattttgtg

SEQ ID NO: 2354 - DNA, 10 bp, Saccharomyces cerevisiae
ggcaacactt

SEQ ID NO: 2355 - DNA, 10 bp, Saccharomyces cerevisiae
gggaaaccgg

SEQ ID NO: 2356 - DNA, 10 bp, Saccharomyces cerevisiae
gggtatcccg

SEQ ID NO: 2357 - DNA, 10 bp, Saccharomyces cerevisiae
gggtgactat

SEQ ID NO: 2358 - DNA, 10 bp, Saccharomyces cerevisiae
gggtgagtaa

SEQ ID NO: 2359 - DNA, 10 bp, Saccharomyces cerevisiae
gggtgctaag

SEQ ID NO: 2360 - DNA, 10 bp, Saccharomyces cerevisiae
gggttgttct

SEQ ID NO: 2361 - DNA, 10 bp, Saccharomyces cerevisiae
gggtttcctg

SEQ ID NO: 2362 - DNA, 10 bp, Saccharomyces cerevisiae
ggtaagcagt

SEQ ID NO: 2363 - DNA, 10 bp, Saccharomyces cerevisiae
ggtacattca

SEQ ID NO: 2364 - DNA, 10 bp, Saccharomyces cerevisiae
ggtgaaagtt

SEQ ID NO: 2365 - DNA, 10 bp, Saccharomyces cerevisiae
ggtgatgaag

SEQ ID NO: 2366 - DNA, 10 bp, Saccharomyces cerevisiae
ggtgctagga

SEQ ID NO: 2367 - DNA, 10 bp, Saccharomyces cerevisiae
ggtggcgagg

SEQ ID NO: 2368 - DNA, 10 bp, Saccharomyces cerevisiae
ggtgtgaagg

SEQ ID NO: 2369 - DNA, 10 bp, Saccharomyces cerevisiae
ggtgttaacc

SEQ ID NO: 2370 - DNA, 10 bp, Saccharomyces cerevisiae
ggtgttagcg

SEQ ID NO: 2371 - DNA, 10 bp, Saccharomyces cerevisiae
ggttaattaa

SEQ ID NO: 2372 - DNA, 10 bp, Saccharomyces cerevisiae
gtaaaagaag

SEQ ID NO: 2373 - DNA, 10 bp, Saccharomyces cerevisiae
gtaagaaatc

SEQ ID NO: 2374 - DNA, 10 bp, Saccharomyces cerevisiae
gtactttctc

SEQ ID NO: 2375 - DNA, 10 bp, Saccharomyces cerevisiae
gtcaagggcc

SEQ ID NO: 2376 - DNA, 10 bp, Saccharomyces cerevisiae
gtccacgcag

SEQ ID NO: 2377 - DNA, 10 bp, Saccharomyces cerevisiae
gtgatgaagt

SEQ ID NO: 2378 - DNA, 10 bp, Saccharomyces cerevisiae
gtgcaacaac

SEQ ID NO: 2379 - DNA, 10 bp, Saccharomyces cerevisiae
gtgttaacga

SEQ ID NO: 2380 - DNA, 10 bp, Saccharomyces cerevisiae
gttaactgat

SEQ ID NO: 2381 - DNA, 10 bp, Saccharomyces cerevisiae
gttggaaggg

SEQ ID NO: 2382 - DNA, 10 bp, Saccharomyces cerevisiae
gttttctttt

SEQ ID NO: 2383 - DNA, 10 bp, Saccharomyces cerevisiae
taaataacaa

SEQ ID NO: 2384 - DNA, 10 bp, Saccharomyces cerevisiae
taaatgttag

SEQ ID NO: 2385 - DNA, 10 bp, Saccharomyces cerevisiae
taaggatggg

SEQ ID NO: 2386 - DNA, 10 bp, Saccharomyces cerevisiae
taatgaaaac

SEQ ID NO: 2387 - DNA, 10 bp, Saccharomyces cerevisiae
tacaaatttg

SEQ ID NO: 2388 - DNA, 10 bp, Saccharomyces cerevisiae
taccctgccg

SEQ ID NO: 2389 - DNA, 10 bp, Saccharomyces cerevisiae
tacgttgatg

SEQ ID NO: 2390 - DNA, 10 bp, Saccharomyces cerevisiae
tagaacaata

SEQ ID NO: 2391 - DNA, 10 bp, Saccharomyces cerevisiae
tagcgtattc

SEQ ID NO: 2392 - DNA, 10 bp, Saccharomyces cerevisiae
tagtaagtaa

SEQ ID NO: 2393 - DNA, 10 bp, Saccharomyces cerevisiae
tagttgctcc

SEQ ID NO: 2394 - DNA, 10 bp, Saccharomyces cerevisiae
tatatatata

SEQ ID NO: 2395 - DNA, 10 bp, Saccharomyces cerevisiae
tatatcagtg

SEQ ID NO: 2396 - DNA, 10 bp, Saccharomyces cerevisiae
tatattaaaa

SEQ ID NO: 2397 - DNA, 10 bp, Saccharomyces cerevisiae
tatgcctaaa

SEQ ID NO: 2398 - DNA, 10 bp, Saccharomyces cerevisiae
tatgctagca

SEQ ID NO: 2399 - DNA, 10 bp, Saccharomyces cerevisiae
tatggaataa

SEQ ID NO: 2400 - DNA, 10 bp, Saccharomyces cerevisiae
tatgggcgac

SEQ ID NO: 2401 - DNA, 10 bp, Saccharomyces cerevisiae
tattttgatg

SEQ ID NO: 2402 - DNA, 10 bp, Saccharomyces cerevisiae
tcagaaacac

SEQ ID NO: 2403 - DNA, 10 bp, Saccharomyces cerevisiae
tcaggtccat

SEQ ID NO: 2404 - DNA, 10 bp, Saccharomyces cerevisiae
tcatcatttc

SEQ ID NO: 2405 - DNA, 10 bp, Saccharomyces cerevisiae
tcatccgtga

SEQ ID NO: 2406 - DNA, 10 bp, Saccharomyces cerevisiae
tccacctact

SEQ ID NO: 2407 - DNA, 10 bp, Saccharomyces cerevisiae
tccccattaa

SEQ ID NO: 2408 - DNA, 10 bp, Saccharomyces cerevisiae
tccccgtatt

SEQ ID NO: 2409 - DNA, 10 bp, Saccharomyces cerevisiae
tccctatcaa

SEQ ID NO: 2410 - DNA, 10 bp, Saccharomyces cerevisiae
tccctattga

SEQ ID NO: 2411 - DNA, 10 bp, Saccharomyces cerevisiae
tccctgttaa

SEQ ID NO: 2412 - DNA, 10 bp, Saccharomyces cerevisiae
tcctagttcg

SEQ ID NO: 2413 - DNA, 10 bp, Saccharomyces cerevisiae
tcgtcatcgg

SEQ ID NO: 2414 - DNA, 10 bp, Saccharomyces cerevisiae
tctcaataac

SEQ ID NO: 2415 - DNA, 10 bp, Saccharomyces cerevisiae
tctctagcta

SEQ ID NO: 2416 - DNA, 10 bp, Saccharomyces cerevisiae
tctggattgc

SEQ ID NO: 2417 - DNA, 10 bp, Saccharomyces cerevisiae
tcttgaaaag

SEQ ID NO: 2418 - DNA, 10 bp, Saccharomyces cerevisiae
tcttggtata

SEQ ID NO: 2419 - DNA, 10 bp, Saccharomyces cerevisiae
tgagtaaatc

SEQ ID NO: 2420 - DNA, 10 bp, Saccharomyces cerevisiae
tgcacaattg

SEQ ID NO: 2421 - DNA, 10 bp, Saccharomyces cerevisiae
tgcagcctgc

SEQ ID NO: 2422 - DNA, 10 bp, Saccharomyces cerevisiae
tgcctcagga

SEQ ID NO: 2423 - DNA, 10 bp, Saccharomyces cerevisiae
tgctgaactt

SEQ ID NO: 2424 - DNA, 10 bp, Saccharomyces cerevisiae
tggcaaaaaa

SEQ ID NO: 2425 - DNA, 10 bp, Saccharomyces cerevisiae
tggcaatatg

SEQ ID NO: 2426 - DNA, 10 bp, Saccharomyces cerevisiae
tggcggaagc

SEQ ID NO: 2427 - DNA, 10 bp, Saccharomyces cerevisiae
tggcgtgaca

SEQ ID NO: 2428 - DNA, 10 bp, Saccharomyces cerevisiae
tggcttaaac

SEQ ID NO: 2429 - DNA, 10 bp, Saccharomyces cerevisiae
tgggatgtag

SEQ ID NO: 2430 - DNA, 10 bp, Saccharomyces cerevisiae
tgggttccaa

SEQ ID NO: 2431 - DNA, 10 bp, Saccharomyces cerevisiae
tgtaagacgg

SEQ ID NO: 2432 - DNA, 10 bp, Saccharomyces cerevisiae
tgtagtttct

SEQ ID NO: 2433 - DNA, 10 bp, Saccharomyces cerevisiae
tgttgtggag

SEQ ID NO: 2434 - DNA, 10 bp, Saccharomyces cerevisiae
ttaccgaagg

SEQ ID NO: 2435 - DNA, 10 bp, Saccharomyces cerevisiae
ttacttgtaa

SEQ ID NO: 2436 - DNA, 10 bp, Saccharomyces cerevisiae
ttagcatagt

SEQ ID NO: 2437 - DNA, 10 bp, Saccharomyces cerevisiae
ttagtagcga

SEQ ID NO: 2438 - DNA, 10 bp, Saccharomyces cerevisiae
ttagttctat

SEQ ID NO: 2439 - DNA, 10 bp, Saccharomyces cerevisiae
ttatgtattg

SEQ ID NO: 2440 - DNA, 10 bp, Saccharomyces cerevisiae
ttcaaattaa

SEQ ID NO: 2441 - DNA, 10 bp, Saccharomyces cerevisiae
ttcaagtacg

SEQ ID NO: 2442 - DNA, 10 bp, Saccharomyces cerevisiae
ttccaaacta

SEQ ID NO: 2443 - DNA, 10 bp, Saccharomyces cerevisiae
ttcctgcctc

SEQ ID NO: 2444 - DNA, 10 bp, Saccharomyces cerevisiae
ttcgttcacc

SEQ ID NO: 2445 - DNA, 10 bp, Saccharomyces cerevisiae
ttgatctatc

SEQ ID NO: 2446 - DNA, 10 bp, Saccharomyces cerevisiae
ttgcaaccaa

SEQ ID NO: 2447 - DNA, 10 bp, Saccharomyces cerevisiae
ttgctaaaga

SEQ ID NO: 2448 - DNA, 10 bp, Saccharomyces cerevisiae
ttggatttgt

SEQ ID NO: 2449 - DNA, 10 bp, Saccharomyces cerevisiae
ttgggtaaaa

SEQ ID NO: 2450 - DNA, 10 bp, Saccharomyces cerevisiae
tttaatagag

SEQ ID NO: 2451 - DNA, 10 bp, Saccharomyces cerevisiae
tttaattacc

SEQ ID NO: 2452 - DNA, 10 bp, Saccharomyces cerevisiae
tttccatcaa

SEQ ID NO: 2453 - DNA, 10 bp, Saccharomyces cerevisiae
tttctaatcc

SEQ ID NO: 2454 - DNA, 10 bp, Saccharomyces cerevisiae
tttggattcc

SEQ ID NO: 2455 - DNA, 10 bp, Saccharomyces cerevisiae
ttttacgtat

SEQ ID NO: 2456 - DNA, 10 bp, Saccharomyces cerevisiae
ttttagtgaa

SEQ ID NO: 2457 - DNA, 10 bp, Saccharomyces cerevisiae
ttttatatat

SEQ ID NO: 2458 - DNA, 10 bp, Saccharomyces cerevisiae
ttttgtatcc

SEQ ID NO: 2459 - DNA, 10 bp, Saccharomyces cerevisiae
tttttcgatt

SEQ ID NO: 2460 - DNA, 10 bp, Saccharomyces cerevisiae
aaaaacttct

SEQ ID NO: 2461 - DNA, 10 bp, Saccharomyces cerevisiae
aaaaataaag

SEQ ID NO: 2462 - DNA, 10 bp, Saccharomyces cerevisiae
aaaaatccag

SEQ ID NO: 2463 - DNA, 10 bp, Saccharomyces cerevisiae
aaaaattttg

SEQ ID NO: 2464 - DNA, 10 bp, Saccharomyces cerevisiae
aaaagaagct

SEQ ID NO: 2465 - DNA, 10 bp, Saccharomyces cerevisiae
aaaagaccgt

SEQ ID NO: 2466 - DNA, 10 bp, Saccharomyces cerevisiae
aaaaggttgt

SEQ ID NO: 2467 - DNA, 10 bp, Saccharomyces cerevisiae
aaaagtttgg

SEQ ID NO: 2468 - DNA, 10 bp, Saccharomyces cerevisiae
aaaatagcga

SEQ ID NO: 2469 - DNA, 10 bp, Saccharomyces cerevisiae
aaaatatggt

SEQ ID NO: 2470 - DNA, 10 bp, Saccharomyces cerevisiae
aaactttgtt

SEQ ID NO: 2471 - DNA, 10 bp, Saccharomyces cerevisiae
aaagaaattt

SEQ ID NO: 2472 - DNA, 10 bp, Saccharomyces cerevisiae
aaagaatttt

SEQ ID NO: 2473 - DNA, 10 bp, Saccharomyces cerevisiae
aaagacccat

SEQ ID NO: 2474 - DNA, 10 bp, Saccharomyces cerevisiae
aaaggttaag

SEQ ID NO: 2475 - DNA, 10 bp, Saccharomyces cerevisiae
aaagttcaag

SEQ ID NO: 2476 - DNA, 10 bp, Saccharomyces cerevisiae
aaataggaat

SEQ ID NO: 2477 - DNA, 10 bp, Saccharomyces cerevisiae
aaatcacagg

SEQ ID NO: 2478 - DNA, 10 bp, Saccharomyces cerevisiae
aaattatcac

SEQ ID NO: 2479 - DNA, 10 bp, Saccharomyces cerevisiae
aaattgaaac

SEQ ID NO: 2480 - DNA, 10 bp, Saccharomyces cerevisiae
aaattgaaga

SEQ ID NO: 2481 - DNA, 10 bp, Saccharomyces cerevisiae
aacaagattg

SEQ ID NO: 2482 - DNA, 10 bp, Saccharomyces cerevisiae
aacatagccc

SEQ ID NO: 2483 - DNA, 10 bp, Saccharomyces cerevisiae
aacatttaca

SEQ ID NO: 2484 - DNA, 10 bp, Saccharomyces cerevisiae
aaccaaaaaa

SEQ ID NO: 2485 - DNA, 10 bp, Saccharomyces cerevisiae
aacgcttcga

SEQ ID NO: 2486 - DNA, 10 bp, Saccharomyces cerevisiae
aacgggaaat

SEQ ID NO: 2487 - DNA, 10 bp, Saccharomyces cerevisiae
aactacttga

SEQ ID NO: 2488 - DNA, 10 bp, Saccharomyces cerevisiae
aactctgcct

SEQ ID NO: 2489 - DNA, 10 bp, Saccharomyces cerevisiae
aactgtacta

SEQ ID NO: 2490 - DNA, 10 bp, Saccharomyces cerevisiae
aagaaggttt

SEQ ID NO: 2491 - DNA, 10 bp, Saccharomyces cerevisiae
aagagctttt

SEQ ID NO: 2492 - DNA, 10 bp, Saccharomyces cerevisiae
aagatagcaa

SEQ ID NO: 2493 - DNA, 10 bp, Saccharomyces cerevisiae
aagattccat

SEQ ID NO: 2494 - DNA, 10 bp, Saccharomyces cerevisiae
aagccagccg

SEQ ID NO: 2495 - DNA, 10 bp, Saccharomyces cerevisiae
aaggcagaaa

SEQ ID NO: 2496 - DNA, 10 bp, Saccharomyces cerevisiae
aaggctatca

SEQ ID NO: 2497 - DNA, 10 bp, Saccharomyces cerevisiae
aagtactgaa

SEQ ID NO: 2498 - DNA, 10 bp, Saccharomyces cerevisiae
aagttaggaa

SEQ ID NO: 2499 - DNA, 10 bp, Saccharomyces cerevisiae
aagttcataa

SEQ ID NO: 2500 - DNA, 10 bp, Saccharomyces cerevisiae
aagttgttaa

SEQ ID NO: 2501 - DNA, 10 bp, Saccharomyces cerevisiae
aagtttttag

SEQ ID NO: 2502 - DNA, 10 bp, Saccharomyces cerevisiae
aatactttaa

SEQ ID NO: 2503 - DNA, 10 bp, Saccharomyces cerevisiae
aatctatggg

SEQ ID NO: 2504 - DNA, 10 bp, Saccharomyces cerevisiae
aatcttataa

SEQ ID NO: 2505 - DNA, 10 bp, Saccharomyces cerevisiae
aattatacag

SEQ ID NO: 2506 - DNA, 10 bp, Saccharomyces cerevisiae
aattcacatt

SEQ ID NO: 2507 - DNA, 10 bp, Saccharomyces cerevisiae
aattgccacc

SEQ ID NO: 2508 - DNA, 10 bp, Saccharomyces cerevisiae
aatttctcca

SEQ ID NO: 2509 - DNA, 10 bp, Saccharomyces cerevisiae
aattttgtac

SEQ ID NO: 2510 - DNA, 10 bp, Saccharomyces cerevisiae
aatttttgat

SEQ ID NO: 2511 - DNA, 10 bp, Saccharomyces cerevisiae
acaaaaaaaa

SEQ ID NO: 2512 - DNA, 10 bp, Saccharomyces cerevisiae
acaacaacta

SEQ ID NO: 2513 - DNA, 10 bp, Saccharomyces cerevisiae
acaatttcat

SEQ ID NO: 2514 - DNA, 10 bp, Saccharomyces cerevisiae
acaccaagag

SEQ ID NO: 2515 - DNA, 10 bp, Saccharomyces cerevisiae
acagcggagg

SEQ ID NO: 2516 - DNA, 10 bp, Saccharomyces cerevisiae
accactggtg

SEQ ID NO: 2517 - DNA, 10 bp, Saccharomyces cerevisiae
accagggtcc

SEQ ID NO: 2518 - DNA, 10 bp, Saccharomyces cerevisiae
acccctgtct

SEQ ID NO: 2519 - DNA, 10 bp, Saccharomyces cerevisiae
accttaccgt

SEQ ID NO: 2520 - DNA, 10 bp, Saccharomyces cerevisiae
acgagaggag

SEQ ID NO: 2521 - DNA, 10 bp, Saccharomyces cerevisiae
acgctcccaa

SEQ ID NO: 2522 - DNA, 10 bp, Saccharomyces cerevisiae
acggagatga

SEQ ID NO: 2523 - DNA, 10 bp, Saccharomyces cerevisiae
acgttcagca

SEQ ID NO: 2524 - DNA, 10 bp, Saccharomyces cerevisiae
acgtttttta

SEQ ID NO: 2525 - DNA, 10 bp, Saccharomyces cerevisiae
actaagccag

SEQ ID NO: 2526 - DNA, 10 bp, Saccharomyces cerevisiae
actcacttac

SEQ ID NO: 2527 - DNA, 10 bp, Saccharomyces cerevisiae
actgatgctt

SEQ ID NO: 2528 - DNA, 10 bp, Saccharomyces cerevisiae
acttcgatga

SEQ ID NO: 2529 - DNA, 10 bp, Saccharomyces cerevisiae
agaaacagga

SEQ ID NO: 2530 - DNA, 10 bp, Saccharomyces cerevisiae
agaaatgggt

SEQ ID NO: 2531 - DNA, 10 bp, Saccharomyces cerevisiae
agaacaaaag

SEQ ID NO: 2532 - DNA, 10 bp, Saccharomyces cerevisiae
agaacagcaa

SEQ ID NO: 2533 - DNA, 10 bp, Saccharomyces cerevisiae
agacacgaaa

SEQ ID NO: 2534 - DNA, 10 bp, Saccharomyces cerevisiae
agactcatcc

SEQ ID NO: 2535 - DNA, 10 bp, Saccharomyces cerevisiae
agagacattc

SEQ ID NO: 2536 - DNA, 10 bp, Saccharomyces cerevisiae
agagaggccc

SEQ ID NO: 2537 - DNA, 10 bp, Saccharomyces cerevisiae
agaggaagta

SEQ ID NO: 2538 - DNA, 10 bp, Saccharomyces cerevisiae
agatgggcga

SEQ ID NO: 2539 - DNA, 10 bp, Saccharomyces cerevisiae
agcatcggtg

SEQ ID NO: 2540 - DNA, 10 bp, Saccharomyces cerevisiae
agccgagata

SEQ ID NO: 2541 - DNA, 10 bp, Saccharomyces cerevisiae
aggaaaagaa

SEQ ID NO: 2542 - DNA, 10 bp, Saccharomyces cerevisiae
aggacaagga

SEQ ID NO: 2543 - DNA, 10 bp, Saccharomyces cerevisiae
aggtcagaca

SEQ ID NO: 2544 - DNA, 10 bp, Saccharomyces cerevisiae
aggtgacaat

SEQ ID NO: 2545 - DNA, 10 bp, Saccharomyces cerevisiae
aggtttatct

SEQ ID NO: 2546 - DNA, 10 bp, Saccharomyces cerevisiae
agtatcatac

SEQ ID NO: 2547 - DNA, 10 bp, Saccharomyces cerevisiae
agtccatcaa

SEQ ID NO: 2548 - DNA, 10 bp, Saccharomyces cerevisiae
agtccggagt

SEQ ID NO: 2549 - DNA, 10 bp, Saccharomyces cerevisiae
agtcgtcgca

SEQ ID NO: 2550 - DNA, 10 bp, Saccharomyces cerevisiae
ataaacgttt

SEQ ID NO: 2551 - DNA, 10 bp, Saccharomyces cerevisiae
ataatcattc

SEQ ID NO: 2552 - DNA, 10 bp, Saccharomyces cerevisiae
atagccgagt

SEQ ID NO: 2553 - DNA, 10 bp, Saccharomyces cerevisiae
ataggatata

SEQ ID NO: 2554 - DNA, 10 bp, Saccharomyces cerevisiae
atataaattt

SEQ ID NO: 2555 - DNA, 10 bp, Saccharomyces cerevisiae
atatagctac

SEQ ID NO: 2556 - DNA, 10 bp, Saccharomyces cerevisiae
atatagctgc

SEQ ID NO: 2557 - DNA, 10 bp, Saccharomyces cerevisiae
atattttatt

SEQ ID NO: 2558 - DNA, 10 bp, Saccharomyces cerevisiae
atattttcgt

SEQ ID NO: 2559 - DNA, 10 bp, Saccharomyces cerevisiae
atccacttgc

SEQ ID NO: 2560 - DNA, 10 bp, Saccharomyces cerevisiae
atcctatttt

SEQ ID NO: 2561 - DNA, 10 bp, Saccharomyces cerevisiae
atcgctggta

SEQ ID NO: 2562 - DNA, 10 bp, Saccharomyces cerevisiae
atcgtccacc

SEQ ID NO: 2563 - DNA, 10 bp, Saccharomyces cerevisiae
atgaaaaatc

SEQ ID NO: 2564 - DNA, 10 bp, Saccharomyces cerevisiae
atgaatccgt

SEQ ID NO: 2565 - DNA, 10 bp, Saccharomyces cerevisiae
atgacattca

SEQ ID NO: 2566 - DNA, 10 bp, Saccharomyces cerevisiae
atggatatat

SEQ ID NO: 2567 - DNA, 10 bp, Saccharomyces cerevisiae
atggatggat

SEQ ID NO: 2568 - DNA, 10 bp, Saccharomyces cerevisiae
atgggcttca

SEQ ID NO: 2569 - DNA, 10 bp, Saccharomyces cerevisiae
atggtgtggc

SEQ ID NO: 2570 - DNA, 10 bp, Saccharomyces cerevisiae
attaaaaaaa

SEQ ID NO: 2571 - DNA, 10 bp, Saccharomyces cerevisiae
attcgcagat

SEQ ID NO: 2572 - DNA, 10 bp, Saccharomyces cerevisiae
attcttcaga

SEQ ID NO: 2573 - DNA, 10 bp, Saccharomyces cerevisiae
attgatgctt

SEQ ID NO: 2574 - DNA, 10 bp, Saccharomyces cerevisiae
attggcagat

SEQ ID NO: 2575 - DNA, 10 bp, Saccharomyces cerevisiae
atttgatttc

SEQ ID NO: 2576 - DNA, 10 bp, Saccharomyces cerevisiae
atttttgagc

SEQ ID NO: 2577 - DNA, 10 bp, Saccharomyces cerevisiae
caaaacccac

SEQ ID NO: 2578 - DNA, 10 bp, Saccharomyces cerevisiae
caaaattaac

SEQ ID NO: 2579 - DNA, 10 bp, Saccharomyces cerevisiae
caagcatcca

SEQ ID NO: 2580 - DNA, 10 bp, Saccharomyces cerevisiae
caatggctga

SEQ ID NO: 2581 - DNA, 10 bp, Saccharomyces cerevisiae
caattccgag

SEQ ID NO: 2582 - DNA, 10 bp, Saccharomyces cerevisiae
cacaagaaaa

SEQ ID NO: 2583 - DNA, 10 bp, Saccharomyces cerevisiae
cacatatagc

SEQ ID NO: 2584 - DNA, 10 bp, Saccharomyces cerevisiae
cacatcataa

SEQ ID NO: 2585 - DNA, 10 bp, Saccharomyces cerevisiae
cactgtataa

SEQ ID NO: 2586 - DNA, 10 bp, Saccharomyces cerevisiae
cagaaatgcg

SEQ ID NO: 2587 - DNA, 10 bp, Saccharomyces cerevisiae
cagaaggtca

SEQ ID NO: 2588 - DNA, 10 bp, Saccharomyces cerevisiae
cagacaaagt

SEQ ID NO: 2589 - DNA, 10 bp, Saccharomyces cerevisiae
cagctcaagc

SEQ ID NO: 2590 - DNA, 10 bp, Saccharomyces cerevisiae
caggatacca

SEQ ID NO: 2591 - DNA, 10 bp, Saccharomyces cerevisiae
cagtaatgtt

SEQ ID NO: 2592 - DNA, 10 bp, Saccharomyces cerevisiae
cagtgatgca

SEQ ID NO: 2593 - DNA, 10 bp, Saccharomyces cerevisiae
cataataatt

SEQ ID NO: 2594 - DNA, 10 bp, Saccharomyces cerevisiae
catataaaaa

SEQ ID NO: 2595 - DNA, 10 bp, Saccharomyces cerevisiae
catcttaccc

SEQ ID NO: 2596 - DNA, 10 bp, Saccharomyces cerevisiae
catttgaagc

SEQ ID NO: 2597 - DNA, 10 bp, Saccharomyces cerevisiae
ccaaaaaaaa

SEQ ID NO: 2598 - DNA, 10 bp, Saccharomyces cerevisiae
ccaatgatga

SEQ ID NO: 2599 - DNA, 10 bp, Saccharomyces cerevisiae
ccacaactga

SEQ ID NO: 2600 - DNA, 10 bp, Saccharomyces cerevisiae
ccactaccgt

SEQ ID NO: 2601 - DNA, 10 bp, Saccharomyces cerevisiae
ccactttggt

SEQ ID NO: 2602 - DNA, 10 bp, Saccharomyces cerevisiae
ccagaagatg

SEQ ID NO: 2603 - DNA, 10 bp, Saccharomyces cerevisiae
ccatactgga

SEQ ID NO: 2604 - DNA, 10 bp, Saccharomyces cerevisiae
ccatcttaag

SEQ ID NO: 2605 - DNA, 10 bp, Saccharomyces cerevisiae
cccaagataa

SEQ ID NO: 2606 - DNA, 10 bp, Saccharomyces cerevisiae
ccccaaaaaa

SEQ ID NO: 2607 - DNA, 10 bp, Saccharomyces cerevisiae
cccttctgta

SEQ ID NO: 2608 - DNA, 10 bp, Saccharomyces cerevisiae
ccgtcgagag

SEQ ID NO: 2609 - DNA, 10 bp, Saccharomyces cerevisiae
cctaaatact

SEQ ID NO: 2610 - DNA, 10 bp, Saccharomyces cerevisiae
cctatttgag

SEQ ID NO: 2611 - DNA, 10 bp, Saccharomyces cerevisiae
cctcttctcc

SEQ ID NO: 2612 - DNA, 10 bp, Saccharomyces cerevisiae
cctgaagaaa

SEQ ID NO: 2613 - DNA, 10 bp, Saccharomyces cerevisiae
cctgcaatgg

SEQ ID NO: 2614 - DNA, 10 bp, Saccharomyces cerevisiae
ccttcactgc

SEQ ID NO: 2615 - DNA, 10 bp, Saccharomyces cerevisiae
ccttgaacta

SEQ ID NO: 2616 - DNA, 10 bp, Saccharomyces cerevisiae
ccttttcaat

SEQ ID NO: 2617 - DNA, 10 bp, Saccharomyces cerevisiae
cgaaaaggct

SEQ ID NO: 2618 - DNA, 10 bp, Saccharomyces cerevisiae
cgaaactaaa

SEQ ID NO: 2619 - DNA, 10 bp, Saccharomyces cerevisiae
cgattcagtt

SEQ ID NO: 2620 - DNA, 10 bp, Saccharomyces cerevisiae
cgcaactggt

SEQ ID NO: 2621 - DNA, 10 bp, Saccharomyces cerevisiae
cgccacggta

SEQ ID NO: 2622 - DNA, 10 bp, Saccharomyces cerevisiae
cgcggcaatt

SEQ ID NO: 2623 - DNA, 10 bp, Saccharomyces cerevisiae
cgcgttcgaa

SEQ ID NO: 2624 - DNA, 10 bp, Saccharomyces cerevisiae
cggcggttct

SEQ ID NO: 2625 - DNA, 10 bp, Saccharomyces cerevisiae
cggcgtagat

SEQ ID NO: 2626 - DNA, 10 bp, Saccharomyces cerevisiae
cggctgagga

SEQ ID NO: 2627 - DNA, 10 bp, Saccharomyces cerevisiae
cggtaccaaa

SEQ ID NO: 2628 - DNA, 10 bp, Saccharomyces cerevisiae
cgtgcagctc

SEQ ID NO: 2629 - DNA, 10 bp, Saccharomyces cerevisiae
cgtgtatttt

SEQ ID NO: 2630 - DNA, 10 bp, Saccharomyces cerevisiae
cgttctacta

SEQ ID NO: 2631 - DNA, 10 bp, Saccharomyces cerevisiae
ctaaagaatg

SEQ ID NO: 2632 - DNA, 10 bp, Saccharomyces cerevisiae
ctagcagcta

SEQ ID NO: 2633 - DNA, 10 bp, Saccharomyces cerevisiae
ctaggtccta

SEQ ID NO: 2634 - DNA, 10 bp, Saccharomyces cerevisiae
ctagtttcta

SEQ ID NO: 2635 - DNA, 10 bp, Saccharomyces cerevisiae
ctcacacaat

SEQ ID NO: 2636 - DNA, 10 bp, Saccharomyces cerevisiae
ctcattgaaa

SEQ ID NO: 2637 - DNA, 10 bp, Saccharomyces cerevisiae
ctctactgcc

SEQ ID NO: 2638 - DNA, 10 bp, Saccharomyces cerevisiae
ctctatttgc

SEQ ID NO: 2639 - DNA, 10 bp, Saccharomyces cerevisiae
ctctgccccc

SEQ ID NO: 2640 - DNA, 10 bp, Saccharomyces cerevisiae
ctgaaaaagt

SEQ ID NO: 2641 - DNA, 10 bp, Saccharomyces cerevisiae
ctgaagcaga

SEQ ID NO: 2642 - DNA, 10 bp, Saccharomyces cerevisiae
ctgagtacaa

SEQ ID NO: 2643 - DNA, 10 bp, Saccharomyces cerevisiae
ctgccagtct

SEQ ID NO: 2644 - DNA, 10 bp, Saccharomyces cerevisiae
cttactgcaa

SEQ ID NO: 2645 - DNA, 10 bp, Saccharomyces cerevisiae
cttagcgccg

SEQ ID NO: 2646 - DNA, 10 bp, Saccharomyces cerevisiae
cttcttttga

SEQ ID NO: 2647 - DNA, 10 bp, Saccharomyces cerevisiae
cttgtatgtg

SEQ ID NO: 2648 - DNA, 10 bp, Saccharomyces cerevisiae
ctttattttt

SEQ ID NO: 2649 - DNA, 10 bp, Saccharomyces cerevisiae
ctttgttaca

SEQ ID NO: 2650 - DNA, 10 bp, Saccharomyces cerevisiae
gaaaaatact

SEQ ID NO: 2651 - DNA, 10 bp, Saccharomyces cerevisiae
gaaaagcacg

SEQ ID NO: 2652 - DNA, 10 bp, Saccharomyces cerevisiae
gaaaaggtca

SEQ ID NO: 2653 - DNA, 10 bp, Saccharomyces cerevisiae
gaaacccagg

SEQ ID NO: 2654 - DNA, 10 bp, Saccharomyces cerevisiae
gaaagaagac

SEQ ID NO: 2655 - DNA, 10 bp, Saccharomyces cerevisiae
gaaagcaacg

SEQ ID NO: 2656 - DNA, 10 bp, Saccharomyces cerevisiae
gaaataactg

SEQ ID NO: 2657 - DNA, 10 bp, Saccharomyces cerevisiae
gaacagattt

SEQ ID NO: 2658 - DNA, 10 bp, Saccharomyces cerevisiae
gaactccaca

SEQ ID NO: 2659 - DNA, 10 bp, Saccharomyces cerevisiae
gaagacggtg

SEQ ID NO: 2660 - DNA, 10 bp, Saccharomyces cerevisiae
gaagcctgtt

SEQ ID NO: 2661 - DNA, 10 bp, Saccharomyces cerevisiae
gaaggtcgtt

SEQ ID NO: 2662 - DNA, 10 bp, Saccharomyces cerevisiae
gaagtagaag

SEQ ID NO: 2663 - DNA, 10 bp, Saccharomyces cerevisiae
gaagtattga

SEQ ID NO: 2664 - DNA, 10 bp, Saccharomyces cerevisiae
gaatacttgg

SEQ ID NO: 2665 - DNA, 10 bp, Saccharomyces cerevisiae
gaatgcagct

SEQ ID NO: 2666 - DNA, 10 bp, Saccharomyces cerevisiae
gaattgaggg

SEQ ID NO: 2667 - DNA, 10 bp, Saccharomyces cerevisiae
gaattggaga

SEQ ID NO: 2668 - DNA, 10 bp, Saccharomyces cerevisiae
gaattgtttt

SEQ ID NO: 2669 - DNA, 10 bp, Saccharomyces cerevisiae
gacaagaaga

SEQ ID NO: 2670 - DNA, 10 bp, Saccharomyces cerevisiae
gacatagaat

SEQ ID NO: 2671 - DNA, 10 bp, Saccharomyces cerevisiae
gacgagcaca

SEQ ID NO: 2672 - DNA, 10 bp, Saccharomyces cerevisiae
gacggtgaca

SEQ ID NO: 2673 - DNA, 10 bp, Saccharomyces cerevisiae
gacttaacca

SEQ ID NO: 2674 - DNA, 10 bp, Saccharomyces cerevisiae
gagacaaact

SEQ ID NO: 2675 - DNA, 10 bp, Saccharomyces cerevisiae
gagagtaaga

SEQ ID NO: 2676 - DNA, 10 bp, Saccharomyces cerevisiae
gaggacttaa

SEQ ID NO: 2677 - DNA, 10 bp, Saccharomyces cerevisiae
gaggccaacg

SEQ ID NO: 2678 - DNA, 10 bp, Saccharomyces cerevisiae
gagtttggcc

SEQ ID NO: 2679 - DNA, 10 bp, Saccharomyces cerevisiae
gatacccaag

SEQ ID NO: 2680 - DNA, 10 bp, Saccharomyces cerevisiae
gatcagggta

SEQ ID NO: 2681 - DNA, 10 bp, Saccharomyces cerevisiae
gatccagttg

SEQ ID NO: 2682 - DNA, 10 bp, Saccharomyces cerevisiae
gatgaattca

SEQ ID NO: 2683 - DNA, 10 bp, Saccharomyces cerevisiae
gcaaaatgga

SEQ ID NO: 2684 - DNA, 10 bp, Saccharomyces cerevisiae
gcaaagcctc

SEQ ID NO: 2685 - DNA, 10 bp, Saccharomyces cerevisiae
gcaccaaaga

SEQ ID NO: 2686 - DNA, 10 bp, Saccharomyces cerevisiae
gcaccggccg

SEQ ID NO: 2687 - DNA, 10 bp, Saccharomyces cerevisiae
gcagatagaa

SEQ ID NO: 2688 - DNA, 10 bp, Saccharomyces cerevisiae
gcagcactgt

SEQ ID NO: 2689 - DNA, 10 bp, Saccharomyces cerevisiae
gcaggagaag

SEQ ID NO: 2690 - DNA, 10 bp, Saccharomyces cerevisiae
gcattgatgt

SEQ ID NO: 2691 - DNA, 10 bp, Saccharomyces cerevisiae
gcatttagat

SEQ ID NO: 2692 - DNA, 10 bp, Saccharomyces cerevisiae
gccaagaaat

SEQ ID NO: 2693 - DNA, 10 bp, Saccharomyces cerevisiae
gccaagttgg

SEQ ID NO: 2694 - DNA, 10 bp, Saccharomyces cerevisiae
gccaggggta

SEQ ID NO: 2695 - DNA, 10 bp, Saccharomyces cerevisiae
gcccgataac

SEQ ID NO: 2696 - DNA, 10 bp, Saccharomyces cerevisiae
gccggcagac

SEQ ID NO: 2697 - DNA, 10 bp, Saccharomyces cerevisiae
gcgaaatcga

SEQ ID NO: 2698 - DNA, 10 bp, Saccharomyces cerevisiae
gcgaaccaac

SEQ ID NO: 2699 - DNA, 10 bp, Saccharomyces cerevisiae
gcgaagttaa

SEQ ID NO: 2700 - DNA, 10 bp, Saccharomyces cerevisiae
gcgatgccac

SEQ ID NO: 2701 - DNA, 10 bp, Saccharomyces cerevisiae
gctacatcac

SEQ ID NO: 2702 - DNA, 10 bp, Saccharomyces cerevisiae
gctatgcaac

SEQ ID NO: 2703 - DNA, 10 bp, Saccharomyces cerevisiae
gctcagtggt

SEQ ID NO: 2704 - DNA, 10 bp, Saccharomyces cerevisiae
gcttgacatc

SEQ ID NO: 2705 - DNA, 10 bp, Saccharomyces cerevisiae
gctttgaaaa

SEQ ID NO: 2706 - DNA, 10 bp, Saccharomyces cerevisiae
gctttgaaat

SEQ ID NO: 2707 - DNA, 10 bp, Saccharomyces cerevisiae
ggaaaaagta

SEQ ID NO: 2708 - DNA, 10 bp, Saccharomyces cerevisiae
ggacaatcag

SEQ ID NO: 2709 - DNA, 10 bp, Saccharomyces cerevisiae
ggactcgtta

SEQ ID NO: 2710 - DNA, 10 bp, Saccharomyces cerevisiae
ggactgtgta

SEQ ID NO: 2711 - DNA, 10 bp, Saccharomyces cerevisiae
ggaggtccgc

SEQ ID NO: 2712 - DNA, 10 bp, Saccharomyces cerevisiae
ggagtagtta

SEQ ID NO: 2713 - DNA, 10 bp, Saccharomyces cerevisiae
ggatcaagaa

SEQ ID NO: 2714 - DNA, 10 bp, Saccharomyces cerevisiae
ggcaaaacag

SEQ ID NO: 2715 - DNA, 10 bp, Saccharomyces cerevisiae
ggcaacagca

SEQ ID NO: 2716 - DNA, 10 bp, Saccharomyces cerevisiae
ggcaagattg

SEQ ID NO: 2717 - DNA, 10 bp, Saccharomyces cerevisiae
ggcaggtagc

SEQ ID NO: 2718 - DNA, 10 bp, Saccharomyces cerevisiae
ggcagtttac

SEQ ID NO: 2719 - DNA, 10 bp, Saccharomyces cerevisiae
ggcatacaat

SEQ ID NO: 2720 - DNA, 10 bp, Saccharomyces cerevisiae
ggcgagcgaa

SEQ ID NO: 2721 - DNA, 10 bp, Saccharomyces cerevisiae
ggcgataacg

SEQ ID NO: 2722 - DNA, 10 bp, Saccharomyces cerevisiae
ggcgctgcaa

SEQ ID NO: 2723 - DNA, 10 bp, Saccharomyces cerevisiae
ggcttcggtt

SEQ ID NO: 2724 - DNA, 10 bp, Saccharomyces cerevisiae
gggcctctga

SEQ ID NO: 2725 - DNA, 10 bp, Saccharomyces cerevisiae
gggtagtact

SEQ ID NO: 2726 - DNA, 10 bp, Saccharomyces cerevisiae
gggtttcggt

SEQ ID NO: 2727 - DNA, 10 bp, Saccharomyces cerevisiae
gggttttggt

SEQ ID NO: 2728 - DNA, 10 bp, Saccharomyces cerevisiae
ggtaatgcta

SEQ ID NO: 2729 - DNA, 10 bp, Saccharomyces cerevisiae
ggtatattca

SEQ ID NO: 2730 - DNA, 10 bp, Saccharomyces cerevisiae
ggtcagtaaa

SEQ ID NO: 2731 - DNA, 10 bp, Saccharomyces cerevisiae
ggtccggctt

SEQ ID NO: 2732 - DNA, 10 bp, Saccharomyces cerevisiae
ggtgaaaccg

SEQ ID NO: 2733 - DNA, 10 bp, Saccharomyces cerevisiae
ggtgacatac

SEQ ID NO: 2734 - DNA, 10 bp, Saccharomyces cerevisiae
ggtgctaagg

SEQ ID NO: 2735 - DNA, 10 bp, Saccharomyces cerevisiae
ggtgcttccg

SEQ ID NO: 2736 - DNA, 10 bp, Saccharomyces cerevisiae
ggttagtcgg

SEQ ID NO: 2737 - DNA, 10 bp, Saccharomyces cerevisiae
ggtttaccaa

SEQ ID NO: 2738 - DNA, 10 bp, Saccharomyces cerevisiae
gtacccttcc

SEQ ID NO: 2739 - DNA, 10 bp, Saccharomyces cerevisiae
gtacgctgtg

SEQ ID NO: 2740 - DNA, 10 bp, Saccharomyces cerevisiae
gtactatttt

SEQ ID NO: 2741 - DNA, 10 bp, Saccharomyces cerevisiae
gtactggtgc

SEQ ID NO: 2742 - DNA, 10 bp, Saccharomyces cerevisiae
gtagcagcaa

SEQ ID NO: 2743 - DNA, 10 bp, Saccharomyces cerevisiae
gtataataaa

SEQ ID NO: 2744 - DNA, 10 bp, Saccharomyces cerevisiae
gtattttgaa

SEQ ID NO: 2745 - DNA, 10 bp, Saccharomyces cerevisiae
gtattttgcg

SEQ ID NO: 2746 - DNA, 10 bp, Saccharomyces cerevisiae
gtccataata

SEQ ID NO: 2747 - DNA, 10 bp, Saccharomyces cerevisiae
gtccatcctg

SEQ ID NO: 2748 - DNA, 10 bp, Saccharomyces cerevisiae
gtcgtgcggt

SEQ ID NO: 2749 - DNA, 10 bp, Saccharomyces cerevisiae
gtctactctt

SEQ ID NO: 2750 - DNA, 10 bp, Saccharomyces cerevisiae
gtctccttgt

SEQ ID NO: 2751 - DNA, 10 bp, Saccharomyces cerevisiae
gtgaaggata

SEQ ID NO: 2752 - DNA, 10 bp, Saccharomyces cerevisiae
gtgaggagaa

SEQ ID NO: 2753 - DNA, 10 bp, Saccharomyces cerevisiae
gtgatagtct

SEQ ID NO: 2754 - DNA, 10 bp, Saccharomyces cerevisiae
gtgccgctgg

SEQ ID NO: 2755 - DNA, 10 bp, Saccharomyces cerevisiae
gtggcagctt

SEQ ID NO: 2756 - DNA, 10 bp, Saccharomyces cerevisiae
gtggtatcac

SEQ ID NO: 2757 - DNA, 10 bp, Saccharomyces cerevisiae
gtggtttact

SEQ ID NO: 2758 - DNA, 10 bp, Saccharomyces cerevisiae
gtgttgaaat

SEQ ID NO: 2759 - DNA, 10 bp, Saccharomyces cerevisiae
gttaaataca

SEQ ID NO: 2760 - DNA, 10 bp, Saccharomyces cerevisiae
gttatcccaa

SEQ ID NO: 2761 - DNA, 10 bp, Saccharomyces cerevisiae
gttcaaaccg

SEQ ID NO: 2762 - DNA, 10 bp, Saccharomyces cerevisiae
gttccaccac

SEQ ID NO: 2763 - DNA, 10 bp, Saccharomyces cerevisiae
gttcgatatt

SEQ ID NO: 2764 - DNA, 10 bp, Saccharomyces cerevisiae
gttctgcacc

SEQ ID NO: 2765 - DNA, 10 bp, Saccharomyces cerevisiae
gttcttgatc

SEQ ID NO: 2766 - DNA, 10 bp, Saccharomyces cerevisiae
gttcttgcct

SEQ ID NO: 2767 - DNA, 10 bp, Saccharomyces cerevisiae
gttggagaac

SEQ ID NO: 2768 - DNA, 10 bp, Saccharomyces cerevisiae
gttgttcagg

SEQ ID NO: 2769 - DNA, 10 bp, Saccharomyces cerevisiae
gtttaggtac

SEQ ID NO: 2770 - DNA, 10 bp, Saccharomyces cerevisiae
gtttctaaaa

SEQ ID NO: 2771 - DNA, 10 bp, Saccharomyces cerevisiae
gtttgacctt

SEQ ID NO: 2772 - DNA, 10 bp, Saccharomyces cerevisiae
gttttagctt

SEQ ID NO: 2773 - DNA, 10 bp, Saccharomyces cerevisiae
taaagatcta

SEQ ID NO: 2774 - DNA, 10 bp, Saccharomyces cerevisiae
taaccagtct

SEQ ID NO: 2775 - DNA, 10 bp, Saccharomyces cerevisiae
taacggctag

SEQ ID NO: 2776 - DNA, 10 bp, Saccharomyces cerevisiae
taactcgtat

SEQ ID NO: 2777 - DNA, 10 bp, Saccharomyces cerevisiae
taagaccaaa

SEQ ID NO: 2778 - DNA, 10 bp, Saccharomyces cerevisiae
tagaaaccag

SEQ ID NO: 2779 - DNA, 10 bp, Saccharomyces cerevisiae
tagattaacg

SEQ ID NO: 2780 - DNA, 10 bp, Saccharomyces cerevisiae
tagcgcaacc

SEQ ID NO: 2781 - DNA, 10 bp, Saccharomyces cerevisiae
taggaactat

SEQ ID NO: 2782 - DNA, 10 bp, Saccharomyces cerevisiae
tagttttgtc

SEQ ID NO: 2783 - DNA, 10 bp, Saccharomyces cerevisiae
tataactagt

SEQ ID NO: 2784 - DNA, 10 bp, Saccharomyces cerevisiae
tataggtcac

SEQ ID NO: 2785 - DNA, 10 bp, Saccharomyces cerevisiae
tatattaatt

SEQ ID NO: 2786 - DNA, 10 bp, Saccharomyces cerevisiae
tatatttttc

SEQ ID NO: 2787 - DNA, 10 bp, Saccharomyces cerevisiae
tatcaccata

SEQ ID NO: 2788 - DNA, 10 bp, Saccharomyces cerevisiae
tatcttagac

SEQ ID NO: 2789 - DNA, 10 bp, Saccharomyces cerevisiae
tatctttttg

SEQ ID NO: 2790 - DNA, 10 bp, Saccharomyces cerevisiae
tatgtcggtg

SEQ ID NO: 2791 - DNA, 10 bp, Saccharomyces cerevisiae
tatgtttgca

SEQ ID NO: 2792 - DNA, 10 bp, Saccharomyces cerevisiae
tattagttgg

SEQ ID NO: 2793 - DNA, 10 bp, Saccharomyces cerevisiae
tcaaaaaaaa

SEQ ID NO: 2794 - DNA, 10 bp, Saccharomyces cerevisiae
tcaaatttgt

SEQ ID NO: 2795 - DNA, 10 bp, Saccharomyces cerevisiae
tcaagaagat

SEQ ID NO: 2796 - DNA, 10 bp, Saccharomyces cerevisiae
tcaatgaaat

SEQ ID NO: 2797 - DNA, 10 bp, Saccharomyces cerevisiae
tcattcatac

SEQ ID NO: 2798 - DNA, 10 bp, Saccharomyces cerevisiae
tccaaaagtt

SEQ ID NO: 2799 - DNA, 10 bp, Saccharomyces cerevisiae
tccatacctg

SEQ ID NO: 2800 - DNA, 10 bp, Saccharomyces cerevisiae
tccctaatta

SEQ ID NO: 2801 - DNA, 10 bp, Saccharomyces cerevisiae
tccgcttcat

SEQ ID NO: 2802 - DNA, 10 bp, Saccharomyces cerevisiae
tcgattctgg

SEQ ID NO: 2803 - DNA, 10 bp, Saccharomyces cerevisiae
tcgcgagacc

SEQ ID NO: 2804 - DNA, 10 bp, Saccharomyces cerevisiae
tctgcagaca

SEQ ID NO: 2805 - DNA, 10 bp, Saccharomyces cerevisiae
tctgtcgaaa

SEQ ID NO: 2806 - DNA, 10 bp, Saccharomyces cerevisiae
tctgttgacg

SEQ ID NO: 2807 - DNA, 10 bp, Saccharomyces cerevisiae
tcttgagatc

SEQ ID NO: 2808 - DNA, 10 bp, Saccharomyces cerevisiae
tcttggatgc

SEQ ID NO: 2809 - DNA, 10 bp, Saccharomyces cerevisiae
tctttgcgaa

SEQ ID NO: 2810 - DNA, 10 bp, Saccharomyces cerevisiae
tgaaaaaaaa

SEQ ID NO: 2811 - DNA, 10 bp, Saccharomyces cerevisiae
tgaacatcta

SEQ ID NO: 2812 - DNA, 10 bp, Saccharomyces cerevisiae
tgaacattgt

SEQ ID NO: 2813 - DNA, 10 bp, Saccharomyces cerevisiae
tgaacctata

SEQ ID NO: 2814 - DNA, 10 bp, Saccharomyces cerevisiae
tgcaggtcct

SEQ ID NO: 2815 - DNA, 10 bp, Saccharomyces cerevisiae
tgccactcct

SEQ ID NO: 2816 - DNA, 10 bp, Saccharomyces cerevisiae
tgcgcgtata

SEQ ID NO: 2817 - DNA, 10 bp, Saccharomyces cerevisiae
tggacttgga

SEQ ID NO: 2818 - DNA, 10 bp, Saccharomyces cerevisiae
tggccagtct

SEQ ID NO: 2819 - DNA, 10 bp, Saccharomyces cerevisiae
tggtgcgtct

SEQ ID NO: 2820 - DNA, 10 bp, Saccharomyces cerevisiae
tggttcagcg

SEQ ID NO: 2821 - DNA, 10 bp, Saccharomyces cerevisiae
tgtaacttgg

SEQ ID NO: 2822 - DNA, 10 bp, Saccharomyces cerevisiae
tgtacgttgt

SEQ ID NO: 2823 - DNA, 10 bp, Saccharomyces cerevisiae
tgtgacggag

SEQ ID NO: 2824 - DNA, 10 bp, Saccharomyces cerevisiae
tgtgataaaa

SEQ ID NO: 2825 - DNA, 10 bp, Saccharomyces cerevisiae
tgttcaagtg

SEQ ID NO: 2826 - DNA, 10 bp, Saccharomyces cerevisiae
tgttctaata

SEQ ID NO: 2827 - DNA, 10 bp, Saccharomyces cerevisiae
ttaaatctga

SEQ ID NO: 2828 - DNA, 10 bp, Saccharomyces cerevisiae
ttaactgtgc

SEQ ID NO: 2829 - DNA, 10 bp, Saccharomyces cerevisiae
ttaagttctt

SEQ ID NO: 2830 - DNA, 10 bp, Saccharomyces cerevisiae
ttaccaccaa

SEQ ID NO: 2831 - DNA, 10 bp, Saccharomyces cerevisiae
ttagaataat

SEQ ID NO: 2832 - DNA, 10 bp, Saccharomyces cerevisiae
ttagtgaagg

SEQ ID NO: 2833 - DNA, 10 bp, Saccharomyces cerevisiae
ttataaggag

SEQ ID NO: 2834 - DNA, 10 bp, Saccharomyces cerevisiae
ttatacattg

SEQ ID NO: 2835 - DNA, 10 bp, Saccharomyces cerevisiae
ttattgagtt

SEQ ID NO: 2836 - DNA, 10 bp, Saccharomyces cerevisiae
ttattgtttt

SEQ ID NO: 2837 - DNA, 10 bp, Saccharomyces cerevisiae
ttatttcaag

SEQ ID NO: 2838 - DNA, 10 bp, Saccharomyces cerevisiae
ttatttgcaa

SEQ ID NO: 2839 - DNA, 10 bp, Saccharomyces cerevisiae
ttcaagtcac

SEQ ID NO: 2840 - DNA, 10 bp, Saccharomyces cerevisiae
ttcatacagc

SEQ ID NO: 2841 - DNA, 10 bp, Saccharomyces cerevisiae
ttcccaagtt

SEQ ID NO: 2842 - DNA, 10 bp, Saccharomyces cerevisiae
ttccgaagga

SEQ ID NO: 2843 - DNA, 10 bp, Saccharomyces cerevisiae
ttcgatatgg

SEQ ID NO: 2844 - DNA, 10 bp, Saccharomyces cerevisiae
ttctcacaat

SEQ ID NO: 2845 - DNA, 10 bp, Saccharomyces cerevisiae
ttgatgatga

SEQ ID NO: 2846 - DNA, 10 bp, Saccharomyces cerevisiae
ttgcaattcg

SEQ ID NO: 2847 - DNA, 10 bp, Saccharomyces cerevisiae
ttggactacc

SEQ ID NO: 2848 - DNA, 10 bp, Saccharomyces cerevisiae
ttgggaatgg

SEQ ID NO: 2849 - DNA, 10 bp, Saccharomyces cerevisiae
ttgtcaacca

SEQ ID NO: 2850 - DNA, 10 bp, Saccharomyces cerevisiae
tttaactctt

SEQ ID NO: 2851 - DNA, 10 bp, Saccharomyces cerevisiae
tttcaggcaa

SEQ ID NO: 2852 - DNA, 10 bp, Saccharomyces cerevisiae
tttccaatca

SEQ ID NO: 2853 - DNA, 10 bp, Saccharomyces cerevisiae
tttctaagcg

SEQ ID NO: 2854 - DNA, 10 bp, Saccharomyces cerevisiae
tttctcaaaa

SEQ ID NO: 2855 - DNA, 10 bp, Saccharomyces cerevisiae
tttctctttg

SEQ ID NO: 2856 - DNA, 10 bp, Saccharomyces cerevisiae
tttggtggtt

SEQ ID NO: 2857 - DNA, 10 bp, Saccharomyces cerevisiae
tttgttggtt

SEQ ID NO: 2858 - DNA, 10 bp, Saccharomyces cerevisiae
ttttacagtg

SEQ ID NO: 2859 - DNA, 10 bp, Saccharomyces cerevisiae
ttttactagc

SEQ ID NO: 2860 - DNA, 10 bp, Saccharomyces cerevisiae
ttttattttt

SEQ ID NO: 2861 - DNA, 10 bp, Saccharomyces cerevisiae
ttttccacgg

SEQ ID NO: 2862 - DNA, 10 bp, Saccharomyces cerevisiae
aaaaaaagca

SEQ ID NO: 2863 - DNA, 10 bp, Saccharomyces cerevisiae
aaaacacctg

SEQ ID NO: 2864 - DNA, 10 bp, Saccharomyces cerevisiae
aaaacttacg

SEQ ID NO: 2865 - DNA, 10 bp, Saccharomyces cerevisiae
aaaacttcag

SEQ ID NO: 2866 - DNA, 10 bp, Saccharomyces cerevisiae
aaaagaaaaa

SEQ ID NO: 2867 - DNA, 10 bp, Saccharomyces cerevisiae
aaaagggaaa

SEQ ID NO: 2868 - DNA, 10 bp, Saccharomyces cerevisiae
aaaagtcatt

SEQ ID NO: 2869 - DNA, 10 bp, Saccharomyces cerevisiae
aaaatattag

SEQ ID NO: 2870 - DNA, 10 bp, Saccharomyces cerevisiae
aaaatgaatg

SEQ ID NO: 2871 - DNA, 10 bp, Saccharomyces cerevisiae
aaacagcttt

SEQ ID NO: 2872 - DNA, 10 bp, Saccharomyces cerevisiae
aaacctgaca

SEQ ID NO: 2873 - DNA, 10 bp, Saccharomyces cerevisiae
aaactgttgt

SEQ ID NO: 2874 - DNA, 10 bp, Saccharomyces cerevisiae
aaagaaaaga

SEQ ID NO: 2875 - DNA, 10 bp, Saccharomyces cerevisiae
aaagaacaat

SEQ ID NO: 2876 - DNA, 10 bp, Saccharomyces cerevisiae
aaagaatgcg

SEQ ID NO: 2877 - DNA, 10 bp, Saccharomyces cerevisiae
aaagacaatg

SEQ ID NO: 2878 - DNA, 10 bp, Saccharomyces cerevisiae
aaagacaccg

SEQ ID NO: 2879 - DNA, 10 bp, Saccharomyces cerevisiae
aaagctgata

SEQ ID NO: 2880 - DNA, 10 bp, Saccharomyces cerevisiae
aaaggaatct

SEQ ID NO: 2881 - DNA, 10 bp, Saccharomyces cerevisiae
aaaggcattt

SEQ ID NO: 2882 - DNA, 10 bp, Saccharomyces cerevisiae
aaagtccaag

SEQ ID NO: 2883 - DNA, 10 bp, Saccharomyces cerevisiae
aaatcaaaac

SEQ ID NO: 2884 - DNA, 10 bp, Saccharomyces cerevisiae
aaatggattt

SEQ ID NO: 2885 - DNA, 10 bp, Saccharomyces cerevisiae
aaatgggtgc

SEQ ID NO: 2886 - DNA, 10 bp, Saccharomyces cerevisiae
aaattcaatt

SEQ ID NO: 2887 - DNA, 10 bp, Saccharomyces cerevisiae
aaatttagta

SEQ ID NO: 2888 - DNA, 10 bp, Saccharomyces cerevisiae
aaatttgaag

SEQ ID NO: 2889 - DNA, 10 bp, Saccharomyces cerevisiae
aaattttgtg

SEQ ID NO: 2890 - DNA, 10 bp, Saccharomyces cerevisiae
aacaaacacc

SEQ ID NO: 2891 - DNA, 10 bp, Saccharomyces cerevisiae
aacaagcatc

SEQ ID NO: 2892 - DNA, 10 bp, Saccharomyces cerevisiae
aacagaaaca

SEQ ID NO: 2893 - DNA, 10 bp, Saccharomyces cerevisiae
aacagtatca

SEQ ID NO: 2894 - DNA, 10 bp, Saccharomyces cerevisiae
aacatcaagg

SEQ ID NO: 2895 - DNA, 10 bp, Saccharomyces cerevisiae
aaccaatctt

SEQ ID NO: 2896 - DNA, 10 bp, Saccharomyces cerevisiae
aaccactcct

SEQ ID NO: 2897 - DNA, 10 bp, Saccharomyces cerevisiae
aacccatttg

SEQ ID NO: 2898 - DNA, 10 bp, Saccharomyces cerevisiae
aaccggttag

SEQ ID NO: 2899 - DNA, 10 bp, Saccharomyces cerevisiae
aacgaaatct

SEQ ID NO: 2900 - DNA, 10 bp, Saccharomyces cerevisiae
aacgacgaag

SEQ ID NO: 2901 - DNA, 10 bp, Saccharomyces cerevisiae
aacgaggatg

SEQ ID NO: 2902 - DNA, 10 bp, Saccharomyces cerevisiae
aacggtggtg

SEQ ID NO: 2903 - DNA, 10 bp, Saccharomyces cerevisiae
aactacttct

SEQ ID NO: 2904 - DNA, 10 bp, Saccharomyces cerevisiae
aactcgcaaa

SEQ ID NO: 2905 - DNA, 10 bp, Saccharomyces cerevisiae
aacttcgtca

SEQ ID NO: 2906 - DNA, 10 bp, Saccharomyces cerevisiae
aagaaaaaag

SEQ ID NO: 2907 - DNA, 10 bp, Saccharomyces cerevisiae
aagaaacggc

SEQ ID NO: 2908 - DNA, 10 bp, Saccharomyces cerevisiae
aagaacgcat

SEQ ID NO: 2909 - DNA, 10 bp, Saccharomyces cerevisiae
aagaagaagc

SEQ ID NO: 2910 - DNA, 10 bp, Saccharomyces cerevisiae
aagagaaaat

SEQ ID NO: 2911 - DNA, 10 bp, Saccharomyces cerevisiae
aagagtactt

SEQ ID NO: 2912 - DNA, 10 bp, Saccharomyces cerevisiae
aagatcaacg

SEQ ID NO: 2913 - DNA, 10 bp, Saccharomyces cerevisiae
aagatccaga

SEQ ID NO: 2914 - DNA, 10 bp, Saccharomyces cerevisiae
aagctggaga

SEQ ID NO: 2915 - DNA, 10 bp, Saccharomyces cerevisiae
aaggattatt

SEQ ID NO: 2916 - DNA, 10 bp, Saccharomyces cerevisiae
aaggtactta

SEQ ID NO: 2917 - DNA, 10 bp, Saccharomyces cerevisiae
aagtcattaa

SEQ ID NO: 2918 - DNA, 10 bp, Saccharomyces cerevisiae
aagtctttga

SEQ ID NO: 2919 - DNA, 10 bp, Saccharomyces cerevisiae
aagttagcaa

SEQ ID NO: 2920 - DNA, 10 bp, Saccharomyces cerevisiae
aagttattgt

SEQ ID NO: 2921 - DNA, 10 bp, Saccharomyces cerevisiae
aatagccgga

SEQ ID NO: 2922 - DNA, 10 bp, Saccharomyces cerevisiae
aatatgaagt

SEQ ID NO: 2923 - DNA, 10 bp, Saccharomyces cerevisiae
aatccgatat

SEQ ID NO: 2924 - DNA, 10 bp, Saccharomyces cerevisiae
aatccttgtt

SEQ ID NO: 2925 - DNA, 10 bp, Saccharomyces cerevisiae
aatcgcagcc

SEQ ID NO: 2926 - DNA, 10 bp, Saccharomyces cerevisiae
aatcgctaga

SEQ ID NO: 2927 - DNA, 10 bp, Saccharomyces cerevisiae
aatcttgaga

SEQ ID NO: 2928 - DNA, 10 bp, Saccharomyces cerevisiae
aatgaggaca

SEQ ID NO: 2929 - DNA, 10 bp, Saccharomyces cerevisiae
aatgccattt

SEQ ID NO: 2930 - DNA, 10 bp, Saccharomyces cerevisiae
aatgctaaaa

SEQ ID NO: 2931 - DNA, 10 bp, Saccharomyces cerevisiae
aatgcttcag

SEQ ID NO: 2932 - DNA, 10 bp, Saccharomyces cerevisiae
aatggtggct

SEQ ID NO: 2933 - DNA, 10 bp, Saccharomyces cerevisiae
aatgtgacgt

SEQ ID NO: 2934 - DNA, 10 bp, Saccharomyces cerevisiae
aattaaaagt

SEQ ID NO: 2935 - DNA, 10 bp, Saccharomyces cerevisiae
aattaacacc

SEQ ID NO: 2936 - DNA, 10 bp, Saccharomyces cerevisiae
aattcgaatg

SEQ ID NO: 2937 - DNA, 10 bp, Saccharomyces cerevisiae
aattcgcata

SEQ ID NO: 2938 - DNA, 10 bp, Saccharomyces cerevisiae
aattgacgaa

SEQ ID NO: 2939 - DNA, 10 bp, Saccharomyces cerevisiae
aattggacga

SEQ ID NO: 2940 - DNA, 10 bp, Saccharomyces cerevisiae
aattggcaga

SEQ ID NO: 2941 - DNA, 10 bp, Saccharomyces cerevisiae
aattttattt

SEQ ID NO: 2942 - DNA, 10 bp, Saccharomyces cerevisiae
acaaaagatg

SEQ ID NO: 2943 - DNA, 10 bp, Saccharomyces cerevisiae
acaagtcttg

SEQ ID NO: 2944 - DNA, 10 bp, Saccharomyces cerevisiae
acaagttgaa

SEQ ID NO: 2945 - DNA, 10 bp, Saccharomyces cerevisiae
acaattattt

SEQ ID NO: 2946 - DNA, 10 bp, Saccharomyces cerevisiae
acaccaagcc

SEQ ID NO: 2947 - DNA, 10 bp, Saccharomyces cerevisiae
acacctccat

SEQ ID NO: 2948 - DNA, 10 bp, Saccharomyces cerevisiae
acacgaatgg

SEQ ID NO: 2949 - DNA, 10 bp, Saccharomyces cerevisiae
acacgtactg

SEQ ID NO: 2950 - DNA, 10 bp, Saccharomyces cerevisiae
acacgtgagg

SEQ ID NO: 2951 - DNA, 10 bp, Saccharomyces cerevisiae
acagcttttt

SEQ ID NO: 2952 - DNA, 10 bp, Saccharomyces cerevisiae
acaggcgtta

SEQ ID NO: 2953 - DNA, 10 bp, Saccharomyces cerevisiae
acagtgctgg

SEQ ID NO: 2954 - DNA, 10 bp, Saccharomyces cerevisiae
acatacgaaa

SEQ ID NO: 2955 - DNA, 10 bp, Saccharomyces cerevisiae
accaataact

SEQ ID NO: 2956 - DNA, 10 bp, Saccharomyces cerevisiae
acccctggtg

SEQ ID NO: 2957 - DNA, 10 bp, Saccharomyces cerevisiae
accctattaa

SEQ ID NO: 2958 - DNA, 10 bp, Saccharomyces cerevisiae
acctataatg

SEQ ID NO: 2959 - DNA, 10 bp, Saccharomyces cerevisiae
acctcattaa

SEQ ID NO: 2960 - DNA, 10 bp, Saccharomyces cerevisiae
acctccaaaa

SEQ ID NO: 2961 - DNA, 10 bp, Saccharomyces cerevisiae
acctctgggt

SEQ ID NO: 2962 - DNA, 10 bp, Saccharomyces cerevisiae
acctttccca

SEQ ID NO: 2963 - DNA, 10 bp, Saccharomyces cerevisiae
acgaaaatcc

SEQ ID NO: 2964 - DNA, 10 bp, Saccharomyces cerevisiae
acgaaaatgg

SEQ ID NO: 2965 - DNA, 10 bp, Saccharomyces cerevisiae
acgagttaaa

SEQ ID NO: 2966 - DNA, 10 bp, Saccharomyces cerevisiae
acgatattca

SEQ ID NO: 2967 - DNA, 10 bp, Saccharomyces cerevisiae
acgctgtttg

SEQ ID NO: 2968 - DNA, 10 bp, Saccharomyces cerevisiae
acggaaaaga

SEQ ID NO: 2969 - DNA, 10 bp, Saccharomyces cerevisiae
actacaagac

SEQ ID NO: 2970 - DNA, 10 bp, Saccharomyces cerevisiae
actattttaa

SEQ ID NO: 2971 - DNA, 10 bp, Saccharomyces cerevisiae
actccagtaa

SEQ ID NO: 2972 - DNA, 10 bp, Saccharomyces cerevisiae
actccgatgg

SEQ ID NO: 2973 - DNA, 10 bp, Saccharomyces cerevisiae
actcctccca

SEQ ID NO: 2974 - DNA, 10 bp, Saccharomyces cerevisiae
actctaacgg

SEQ ID NO: 2975 - DNA, 10 bp, Saccharomyces cerevisiae
actgctatag

SEQ ID NO: 2976 - DNA, 10 bp, Saccharomyces cerevisiae
actgtagaaa

SEQ ID NO: 2977 - DNA, 10 bp, Saccharomyces cerevisiae
actgtggttc

SEQ ID NO: 2978 - DNA, 10 bp, Saccharomyces cerevisiae
acttcccaag

SEQ ID NO: 2979 - DNA, 10 bp, Saccharomyces cerevisiae
agaaaaaaaa

SEQ ID NO: 2980 - DNA, 10 bp, Saccharomyces cerevisiae
agaaaacaga

SEQ ID NO: 2981 - DNA, 10 bp, Saccharomyces cerevisiae
agaaactgta

SEQ ID NO: 2982 - DNA, 10 bp, Saccharomyces cerevisiae
agaaagaggg

SEQ ID NO: 2983 - DNA, 10 bp, Saccharomyces cerevisiae
agaaatctct

SEQ ID NO: 2984 - DNA, 10 bp, Saccharomyces cerevisiae
agaagcaagt

SEQ ID NO: 2985 - DNA, 10 bp, Saccharomyces cerevisiae
agaataatga

SEQ ID NO: 2986 - DNA, 10 bp, Saccharomyces cerevisiae
agaccaactg

SEQ ID NO: 2987 - DNA, 10 bp, Saccharomyces cerevisiae
agacgcggct

SEQ ID NO: 2988 - DNA, 10 bp, Saccharomyces cerevisiae
agactataca

SEQ ID NO: 2989 - DNA, 10 bp, Saccharomyces cerevisiae
agagacatcg

SEQ ID NO: 2990 - DNA, 10 bp, Saccharomyces cerevisiae
agagagatgt

SEQ ID NO: 2991 - DNA, 10 bp, Saccharomyces cerevisiae
agagcgtaca

SEQ ID NO: 2992 - DNA, 10 bp, Saccharomyces cerevisiae
agagtgcaaa

SEQ ID NO: 2993 - DNA, 10 bp, Saccharomyces cerevisiae
agagtgtttt

SEQ ID NO: 2994 - DNA, 10 bp, Saccharomyces cerevisiae
agatcagtaa

SEQ ID NO: 2995 - DNA, 10 bp, Saccharomyces cerevisiae
agatggttcc

SEQ ID NO: 2996 - DNA, 10 bp, Saccharomyces cerevisiae
agcagaacca

SEQ ID NO: 2997 - DNA, 10 bp, Saccharomyces cerevisiae
agccgattat

SEQ ID NO: 2998 - DNA, 10 bp, Saccharomyces cerevisiae
agcgtaataa

SEQ ID NO: 2999 - DNA, 10 bp, Saccharomyces cerevisiae
agcttgttcc

SEQ ID NO: 3000 - DNA, 10 bp, Saccharomyces cerevisiae
aggacaccaa

SEQ ID NO: 3001 - DNA, 10 bp, Saccharomyces cerevisiae
aggatgatga

SEQ ID NO: 3002 - DNA, 10 bp, Saccharomyces cerevisiae
aggattctga

SEQ ID NO: 3003 - DNA, 10 bp, Saccharomyces cerevisiae
aggcatcttg

SEQ ID NO: 3004 - DNA, 10 bp, Saccharomyces cerevisiae
aggtagatct

SEQ ID NO: 3005 - DNA, 10 bp, Saccharomyces cerevisiae
agtaattcta

SEQ ID NO: 3006 - DNA, 10 bp, Saccharomyces cerevisiae
agtcaaaatg

SEQ ID NO: 3007 - DNA, 10 bp, Saccharomyces cerevisiae
agtcaacctt

SEQ ID NO: 3008 - DNA, 10 bp, Saccharomyces cerevisiae
agtccagttg

SEQ ID NO: 3009 - DNA, 10 bp, Saccharomyces cerevisiae
agtgagtata

SEQ ID NO: 3010 - DNA, 10 bp, Saccharomyces cerevisiae
agttgctatg

SEQ ID NO: 3011 - DNA, 10 bp, Saccharomyces cerevisiae
agtttgttta

SEQ ID NO: 3012 - DNA, 10 bp, Saccharomyces cerevisiae
agttttacag

SEQ ID NO: 3013 - DNA, 10 bp, Saccharomyces cerevisiae
ataaagaaca

SEQ ID NO: 3014 - DNA, 10 bp, Saccharomyces cerevisiae
ataacgaaaa

SEQ ID NO: 3015 - DNA, 10 bp, Saccharomyces cerevisiae
ataagacagt

SEQ ID NO: 3016 - DNA, 10 bp, Saccharomyces cerevisiae
ataaggatgg

SEQ ID NO: 3017 - DNA, 10 bp, Saccharomyces cerevisiae
ataaggcgat

SEQ ID NO: 3018 - DNA, 10 bp, Saccharomyces cerevisiae
ataataaaaa

SEQ ID NO: 3019 - DNA, 10 bp, Saccharomyces cerevisiae
ataatattcg

SEQ ID NO: 3020 - DNA, 10 bp, Saccharomyces cerevisiae
ataatggaac

SEQ ID NO: 3021 - DNA, 10 bp, Saccharomyces cerevisiae
ataattttta

SEQ ID NO: 3022 - DNA, 10 bp, Saccharomyces cerevisiae
ataccagcag

SEQ ID NO: 3023 - DNA, 10 bp, Saccharomyces cerevisiae
ataccagctt

SEQ ID NO: 3024 - DNA, 10 bp, Saccharomyces cerevisiae
atactttttt

SEQ ID NO: 3025 - DNA, 10 bp, Saccharomyces cerevisiae
atagcgttga

SEQ ID NO: 3026 - DNA, 10 bp, Saccharomyces cerevisiae
atagctgccc

SEQ ID NO: 3027 - DNA, 10 bp, Saccharomyces cerevisiae
atagttcgga

SEQ ID NO: 3028 - DNA, 10 bp, Saccharomyces cerevisiae
atattaaaaa

SEQ ID NO: 3029 - DNA, 10 bp, Saccharomyces cerevisiae
atcataaaaa

SEQ ID NO: 3030 - DNA, 10 bp, Saccharomyces cerevisiae
atccaatctc

SEQ ID NO: 3031 - DNA, 10 bp, Saccharomyces cerevisiae
atccatccac

SEQ ID NO: 3032 - DNA, 10 bp, Saccharomyces cerevisiae
atcgaccgcg

SEQ ID NO: 3033 - DNA, 10 bp, Saccharomyces cerevisiae
atcgccgctt

SEQ ID NO: 3034 - DNA, 10 bp, Saccharomyces cerevisiae
atcgcgctca

SEQ ID NO: 3035 - DNA, 10 bp, Saccharomyces cerevisiae
atctagaact

SEQ ID NO: 3036 - DNA, 10 bp, Saccharomyces cerevisiae
atctagaatc

SEQ ID NO: 3037 - DNA, 10 bp, Saccharomyces cerevisiae
atctcatcat

SEQ ID NO: 3038 - DNA, 10 bp, Saccharomyces cerevisiae
atctgaaaaa

SEQ ID NO: 3039 - DNA, 10 bp, Saccharomyces cerevisiae
atcttggata

SEQ ID NO: 3040 - DNA, 10 bp, Saccharomyces cerevisiae
atcttgttac

SEQ ID NO: 3041 - DNA, 10 bp, Saccharomyces cerevisiae
atgaaaaaaa

SEQ ID NO: 3042 - DNA, 10 bp, Saccharomyces cerevisiae
atgaagttcc

SEQ ID NO: 3043 - DNA, 10 bp, Saccharomyces cerevisiae
atgaattata

SEQ ID NO: 3044 - DNA, 10 bp, Saccharomyces cerevisiae
atgacagaca

SEQ ID NO: 3045 - DNA, 10 bp, Saccharomyces cerevisiae
atgaccataa

SEQ ID NO: 3046 - DNA, 10 bp, Saccharomyces cerevisiae
atgacggcag

SEQ ID NO: 3047 - DNA, 10 bp, Saccharomyces cerevisiae
atgagggcaa

SEQ ID NO: 3048 - DNA, 10 bp, Saccharomyces cerevisiae
atgctagatg

SEQ ID NO: 3049 - DNA, 10 bp, Saccharomyces cerevisiae
atggaagccc

SEQ ID NO: 3050 - DNA, 10 bp, Saccharomyces cerevisiae
atggagttgt

SEQ ID NO: 3051 - DNA, 10 bp, Saccharomyces cerevisiae
atggccattc

SEQ ID NO: 3052 - DNA, 10 bp, Saccharomyces cerevisiae
atggccgtag

SEQ ID NO: 3053 - DNA, 10 bp, Saccharomyces cerevisiae
atgggctcca

SEQ ID NO: 3054 - DNA, 10 bp, Saccharomyces cerevisiae
atgtaggcga

SEQ ID NO: 3055 - DNA, 10 bp, Saccharomyces cerevisiae
atgtatagtc

SEQ ID NO: 3056 - DNA, 10 bp, Saccharomyces cerevisiae
atgttgggga

SEQ ID NO: 3057 - DNA, 10 bp, Saccharomyces cerevisiae
attaaaagtt

SEQ ID NO: 3058 - DNA, 10 bp, Saccharomyces cerevisiae
attaaactag

SEQ ID NO: 3059 - DNA, 10 bp, Saccharomyces cerevisiae
attaacgttg

SEQ ID NO: 3060 - DNA, 10 bp, Saccharomyces cerevisiae
attatgggag

SEQ ID NO: 3061 - DNA, 10 bp, Saccharomyces cerevisiae
attcccggaa

SEQ ID NO: 3062 - DNA, 10 bp, Saccharomyces cerevisiae
attcctgacg

SEQ ID NO: 3063 - DNA, 10 bp, Saccharomyces cerevisiae
attcgttgga

SEQ ID NO: 3064 - DNA, 10 bp, Saccharomyces cerevisiae
attctttgcc

SEQ ID NO: 3065 - DNA, 10 bp, Saccharomyces cerevisiae
attctttgga

SEQ ID NO: 3066 - DNA, 10 bp, Saccharomyces cerevisiae
attcttttcg

SEQ ID NO: 3067 - DNA, 10 bp, Saccharomyces cerevisiae
attgaggtgc

SEQ ID NO: 3068 - DNA, 10 bp, Saccharomyces cerevisiae
attgctaagg

SEQ ID NO: 3069 - DNA, 10 bp, Saccharomyces cerevisiae
attgggttcg

SEQ ID NO: 3070 - DNA, 10 bp, Saccharomyces cerevisiae
attggtggtc

SEQ ID NO: 3071 - DNA, 10 bp, Saccharomyces cerevisiae
attgtattta

SEQ ID NO: 3072 - DNA, 10 bp, Saccharomyces cerevisiae
atttattcat

SEQ ID NO: 3073 - DNA, 10 bp, Saccharomyces cerevisiae
atttcaccct

SEQ ID NO: 3074 - DNA, 10 bp, Saccharomyces cerevisiae
atttcagaaa

SEQ ID NO: 3075 - DNA, 10 bp, Saccharomyces cerevisiae
atttcagttt

SEQ ID NO: 3076 - DNA, 10 bp, Saccharomyces cerevisiae
atttccatat

SEQ ID NO: 3077 - DNA, 10 bp, Saccharomyces cerevisiae
atttcttccc

SEQ ID NO: 3078 - DNA, 10 bp, Saccharomyces cerevisiae
atttgcagaa

SEQ ID NO: 3079 - DNA, 10 bp, Saccharomyces cerevisiae
atttggccat

SEQ ID NO: 3080 - DNA, 10 bp, Saccharomyces cerevisiae
attttacata

SEQ ID NO: 3081 - DNA, 10 bp, Saccharomyces cerevisiae
attttatttg

SEQ ID NO: 3082 - DNA, 10 bp, Saccharomyces cerevisiae
atttttaaaa

SEQ ID NO: 3083 - DNA, 10 bp, Saccharomyces cerevisiae
atttttgtgt

SEQ ID NO: 3084 - DNA, 10 bp, Saccharomyces cerevisiae
attttttaaa

SEQ ID NO: 3085 - DNA, 10 bp, Saccharomyces cerevisiae
caaaaaatcg

SEQ ID NO: 3086 - DNA, 10 bp, Saccharomyces cerevisiae
caaaaccaaa

SEQ ID NO: 3087 - DNA, 10 bp, Saccharomyces cerevisiae
caaaacccca

SEQ ID NO: 3088 - DNA, 10 bp, Saccharomyces cerevisiae
caaaattaga

SEQ ID NO: 3089 - DNA, 10 bp, Saccharomyces cerevisiae
caaacaaacg

SEQ ID NO: 3090 - DNA, 10 bp, Saccharomyces cerevisiae
caaacccaac

SEQ ID NO: 3091 - DNA, 10 bp, Saccharomyces cerevisiae
caaagaaacc

SEQ ID NO: 3092 - DNA, 10 bp, Saccharomyces cerevisiae
caacaaagca

SEQ ID NO: 3093 - DNA, 10 bp, Saccharomyces cerevisiae
caacacccaa

SEQ ID NO: 3094 - DNA, 10 bp, Saccharomyces cerevisiae
caaccccatc

SEQ ID NO: 3095 - DNA, 10 bp, Saccharomyces cerevisiae
caagaatgca

SEQ ID NO: 3096 - DNA, 10 bp, Saccharomyces cerevisiae
caagacacgt

SEQ ID NO: 3097 - DNA, 10 bp, Saccharomyces cerevisiae
caagattgat

SEQ ID NO: 3098 - DNA, 10 bp, Saccharomyces cerevisiae
caaggagcct

SEQ ID NO: 3099 - DNA, 10 bp, Saccharomyces cerevisiae
caattcacct

SEQ ID NO: 3100 - DNA, 10 bp, Saccharomyces cerevisiae
caattcctac

SEQ ID NO: 3101 - DNA, 10 bp, Saccharomyces cerevisiae
caattttcag

SEQ ID NO: 3102 - DNA, 10 bp, Saccharomyces cerevisiae
cacattcgtt

SEQ ID NO: 3103 - DNA, 10 bp, Saccharomyces cerevisiae
caccactcct

SEQ ID NO: 3104 - DNA, 10 bp, Saccharomyces cerevisiae
cacctgtttg

SEQ ID NO: 3105 - DNA, 10 bp, Saccharomyces cerevisiae
cacgtacaca

SEQ ID NO: 3106 - DNA, 10 bp, Saccharomyces cerevisiae
cacgtttcta

SEQ ID NO: 3107 - DNA, 10 bp, Saccharomyces cerevisiae
cacttgactt

SEQ ID NO: 3108 - DNA, 10 bp, Saccharomyces cerevisiae
cagaaatagc

SEQ ID NO: 3109 - DNA, 10 bp, Saccharomyces cerevisiae
cagaagttta

SEQ ID NO: 3110 - DNA, 10 bp, Saccharomyces cerevisiae
cagaatttga

SEQ ID NO: 3111 - DNA, 10 bp, Saccharomyces cerevisiae
cagatgagtg

SEQ ID NO: 3112 - DNA, 10 bp, Saccharomyces cerevisiae
cagccctgag

SEQ ID NO: 3113 - DNA, 10 bp, Saccharomyces cerevisiae
cagctcaaca

SEQ ID NO: 3114 - DNA, 10 bp, Saccharomyces cerevisiae
caggaatgaa

SEQ ID NO: 3115 - DNA, 10 bp, Saccharomyces cerevisiae
caggtaccgc

SEQ ID NO: 3116 - DNA, 10 bp, Saccharomyces cerevisiae
caggttttgt

SEQ ID NO: 3117 - DNA, 10 bp, Saccharomyces cerevisiae
cagtactttc

SEQ ID NO: 3118 - DNA, 10 bp, Saccharomyces cerevisiae
cagtccttgc

SEQ ID NO: 3119 - DNA, 10 bp, Saccharomyces cerevisiae
cagtggctct

SEQ ID NO: 3120 - DNA, 10 bp, Saccharomyces cerevisiae
cagtttctat

SEQ ID NO: 3121 - DNA, 10 bp, Saccharomyces cerevisiae
catacataca

SEQ ID NO: 3122 - DNA, 10 bp, Saccharomyces cerevisiae
catacatatt

SEQ ID NO: 3123 - DNA, 10 bp, Saccharomyces cerevisiae
catacgttat

SEQ ID NO: 3124 - DNA, 10 bp, Saccharomyces cerevisiae
catacttcaa

SEQ ID NO: 3125 - DNA, 10 bp, Saccharomyces cerevisiae
catatttctg

SEQ ID NO: 3126 - DNA, 10 bp, Saccharomyces cerevisiae
cattaccccg

SEQ ID NO: 3127 - DNA, 10 bp, Saccharomyces cerevisiae
cattcaatgg

SEQ ID NO: 3128 - DNA, 10 bp, Saccharomyces cerevisiae
cattcacgat

SEQ ID NO: 3129 - DNA, 10 bp, Saccharomyces cerevisiae
cattccctat

SEQ ID NO: 3130 - DNA, 10 bp, Saccharomyces cerevisiae
cattgatcct

SEQ ID NO: 3131 - DNA, 10 bp, Saccharomyces cerevisiae
cattggtact

SEQ ID NO: 3132 - DNA, 10 bp, Saccharomyces cerevisiae
catttttaaa

SEQ ID NO: 3133 - DNA, 10 bp, Saccharomyces cerevisiae
cattttttcc

SEQ ID NO: 3134 - DNA, 10 bp, Saccharomyces cerevisiae
ccaagatcaa

SEQ ID NO: 3135 - DNA, 10 bp, Saccharomyces cerevisiae
ccaagggtac

SEQ ID NO: 3136 - DNA, 10 bp, Saccharomyces cerevisiae
ccaatattta

SEQ ID NO: 3137 - DNA, 10 bp, Saccharomyces cerevisiae
ccacagtagt

SEQ ID NO: 3138 - DNA, 10 bp, Saccharomyces cerevisiae
ccacggttga

SEQ ID NO: 3139 - DNA, 10 bp, Saccharomyces cerevisiae
ccactgtcag

SEQ ID NO: 3140 - DNA, 10 bp, Saccharomyces cerevisiae
ccactttttg

SEQ ID NO: 3141 - DNA, 10 bp, Saccharomyces cerevisiae
ccagatattt

SEQ ID NO: 3142 - DNA, 10 bp, Saccharomyces cerevisiae
ccagtaatcc

SEQ ID NO: 3143 - DNA, 10 bp, Saccharomyces cerevisiae
ccatcaacag

SEQ ID NO: 3144 - DNA, 10 bp, Saccharomyces cerevisiae
ccatccttac

SEQ ID NO: 3145 - DNA, 10 bp, Saccharomyces cerevisiae
cccaatattt

SEQ ID NO: 3146 - DNA, 10 bp, Saccharomyces cerevisiae
cccaatttct

SEQ ID NO: 3147 - DNA, 10 bp, Saccharomyces cerevisiae
cccagctgcc

SEQ ID NO: 3148 - DNA, 10 bp, Saccharomyces cerevisiae
cccattatct

SEQ ID NO: 3149 - DNA, 10 bp, Saccharomyces cerevisiae
cccgtattat

SEQ ID NO: 3150 - DNA, 10 bp, Saccharomyces cerevisiae
cccgtcacaa

SEQ ID NO: 3151 - DNA, 10 bp, Saccharomyces cerevisiae
ccgaaacagg

SEQ ID NO: 3152 - DNA, 10 bp, Saccharomyces cerevisiae
ccgacagtaa

SEQ ID NO: 3153 - DNA, 10 bp, Saccharomyces cerevisiae
ccgatgtcta

SEQ ID NO: 3154 - DNA, 10 bp, Saccharomyces cerevisiae
cctccaacgg

SEQ ID NO: 3155 - DNA, 10 bp, Saccharomyces cerevisiae
cctctactgg

SEQ ID NO: 3156 - DNA, 10 bp, Saccharomyces cerevisiae
cctgtttttg

SEQ ID NO: 3157 - DNA, 10 bp, Saccharomyces cerevisiae
ccttaagggt

SEQ ID NO: 3158 - DNA, 10 bp, Saccharomyces cerevisiae
cctttagaat

SEQ ID NO: 3159 - DNA, 10 bp, Saccharomyces cerevisiae
cctttcaaat

SEQ ID NO: 3160 - DNA, 10 bp, Saccharomyces cerevisiae
cctttctgaa

SEQ ID NO: 3161 - DNA, 10 bp, Saccharomyces cerevisiae
cgaagtcaaa

SEQ ID NO: 3162 - DNA, 10 bp, Saccharomyces cerevisiae
cgactgctaa

SEQ ID NO: 3163 - DNA, 10 bp, Saccharomyces cerevisiae
cgactgtaaa

SEQ ID NO: 3164 - DNA, 10 bp, Saccharomyces cerevisiae
cgagtcaatt

SEQ ID NO: 3165 - DNA, 10 bp, Saccharomyces cerevisiae
cgatatccac

SEQ ID NO: 3166 - DNA, 10 bp, Saccharomyces cerevisiae
cgatcaaagc

SEQ ID NO: 3167 - DNA, 10 bp, Saccharomyces cerevisiae
cgcaaagcga

SEQ ID NO: 3168 - DNA, 10 bp, Saccharomyces cerevisiae
cgcaaggtcc

SEQ ID NO: 3169 - DNA, 10 bp, Saccharomyces cerevisiae
cgcagttata

SEQ ID NO: 3170 - DNA, 10 bp, Saccharomyces cerevisiae
cgcattatta

SEQ ID NO: 3171 - DNA, 10 bp, Saccharomyces cerevisiae
cgcctgctta

SEQ ID NO: 3172 - DNA, 10 bp, Saccharomyces cerevisiae
cgcctgttta

SEQ ID NO: 3173 - DNA, 10 bp, Saccharomyces cerevisiae
cgcttccaat

SEQ ID NO: 3174 - DNA, 10 bp, Saccharomyces cerevisiae
cggagttcca

SEQ ID NO: 3175 - DNA, 10 bp, Saccharomyces cerevisiae
cggcagtgaa

SEQ ID NO: 3176 - DNA, 10 bp, Saccharomyces cerevisiae
cggccaagac

SEQ ID NO: 3177 - DNA, 10 bp, Saccharomyces cerevisiae
cggccattat

SEQ ID NO: 3178 - DNA, 10 bp, Saccharomyces cerevisiae
cggccctttt

SEQ ID NO: 3179 - DNA, 10 bp, Saccharomyces cerevisiae
cggtaaaaac

SEQ ID NO: 3180 - DNA, 10 bp, Saccharomyces cerevisiae
cggtaatccc

SEQ ID NO: 3181 - DNA, 10 bp, Saccharomyces cerevisiae
cgtacacgcg

SEQ ID NO: 3182 - DNA, 10 bp, Saccharomyces cerevisiae
cgtatttaag

SEQ ID NO: 3183 - DNA, 10 bp, Saccharomyces cerevisiae
cgtctccgga

SEQ ID NO: 3184 - DNA, 10 bp, Saccharomyces cerevisiae
cgttgcgaaa

SEQ ID NO: 3185 - DNA, 10 bp, Saccharomyces cerevisiae
ctaaaaaaaa

SEQ ID NO: 3186 - DNA, 10 bp, Saccharomyces cerevisiae
ctaacttccg

SEQ ID NO: 3187 - DNA, 10 bp, Saccharomyces cerevisiae
ctaagagctg

SEQ ID NO: 3188 - DNA, 10 bp, Saccharomyces cerevisiae
ctacagaaga

SEQ ID NO: 3189 - DNA, 10 bp, Saccharomyces cerevisiae
ctacctctga

SEQ ID NO: 3190 - DNA, 10 bp, Saccharomyces cerevisiae
ctactgccaa

SEQ ID NO: 3191 - DNA, 10 bp, Saccharomyces cerevisiae
ctacttctgc

SEQ ID NO: 3192 - DNA, 10 bp, Saccharomyces cerevisiae
ctagtcggcc

SEQ ID NO: 3193 - DNA, 10 bp, Saccharomyces cerevisiae
ctagtgttgt

SEQ ID NO: 3194 - DNA, 10 bp, Saccharomyces cerevisiae
ctatgtcgta

SEQ ID NO: 3195 - DNA, 10 bp, Saccharomyces cerevisiae
ctcaagaggg

SEQ ID NO: 3196 - DNA, 10 bp, Saccharomyces cerevisiae
ctctacagta

SEQ ID NO: 3197 - DNA, 10 bp, Saccharomyces cerevisiae
ctctactggt

SEQ ID NO: 3198 - DNA, 10 bp, Saccharomyces cerevisiae
ctctagataa

SEQ ID NO: 3199 - DNA, 10 bp, Saccharomyces cerevisiae
ctctattcaa

SEQ ID NO: 3200 - DNA, 10 bp, Saccharomyces cerevisiae
ctctccggcg

SEQ ID NO: 3201 - DNA, 10 bp, Saccharomyces cerevisiae
ctcttcatct

SEQ ID NO: 3202 - DNA, 10 bp, Saccharomyces cerevisiae
ctgattgcca

SEQ ID NO: 3203 - DNA, 10 bp, Saccharomyces cerevisiae
ctgcagtgtt

SEQ ID NO: 3204 - DNA, 10 bp, Saccharomyces cerevisiae
ctgctcaaaa

SEQ ID NO: 3205 - DNA, 10 bp, Saccharomyces cerevisiae
ctggaaccta

SEQ ID NO: 3206 - DNA, 10 bp, Saccharomyces cerevisiae
ctggtagaaa

SEQ ID NO: 3207 - DNA, 10 bp, Saccharomyces cerevisiae
ctgtgcggga

SEQ ID NO: 3208 - DNA, 10 bp, Saccharomyces cerevisiae
ctgttatttt

SEQ ID NO: 3209 - DNA, 10 bp, Saccharomyces cerevisiae
ctgttgttgt

SEQ ID NO: 3210 - DNA, 10 bp, Saccharomyces cerevisiae
cttacactat

SEQ ID NO: 3211 - DNA, 10 bp, Saccharomyces cerevisiae
cttacatata

SEQ ID NO: 3212 - DNA, 10 bp, Saccharomyces cerevisiae
cttaccccag

SEQ ID NO: 3213 - DNA, 10 bp, Saccharomyces cerevisiae
cttacgatta

SEQ ID NO: 3214 - DNA, 10 bp, Saccharomyces cerevisiae
cttcaaggtt

SEQ ID NO: 3215 - DNA, 10 bp, Saccharomyces cerevisiae
cttcagaaaa

SEQ ID NO: 3216 - DNA, 10 bp, Saccharomyces cerevisiae
cttctgaaga

SEQ ID NO: 3217 - DNA, 10 bp, Saccharomyces cerevisiae
cttcttctgc

SEQ ID NO: 3218 - DNA, 10 bp, Saccharomyces cerevisiae
cttgatgctt

SEQ ID NO: 3219 - DNA, 10 bp, Saccharomyces cerevisiae
cttgtaggaa

SEQ ID NO: 3220 - DNA, 10 bp, Saccharomyces cerevisiae
ctttttagtt

SEQ ID NO: 3221 - DNA, 10 bp, Saccharomyces cerevisiae
ctttttttcc

SEQ ID NO: 3222 - DNA, 10 bp, Saccharomyces cerevisiae
gaaacaacga

SEQ ID NO: 3223 - DNA, 10 bp, Saccharomyces cerevisiae
gaaacctgct

SEQ ID NO: 3224 - DNA, 10 bp, Saccharomyces cerevisiae
gaaacttgga

SEQ ID NO: 3225 - DNA, 10 bp, Saccharomyces cerevisiae
gaaactttat

SEQ ID NO: 3226 - DNA, 10 bp, Saccharomyces cerevisiae
gaaagctaga

SEQ ID NO: 3227 - DNA, 10 bp, Saccharomyces cerevisiae
gaaagctttt

SEQ ID NO: 3228 - DNA, 10 bp, Saccharomyces cerevisiae
gaaaggaaaa

SEQ ID NO: 3229 - DNA, 10 bp, Saccharomyces cerevisiae
gaaagggtat

SEQ ID NO: 3230 - DNA, 10 bp, Saccharomyces cerevisiae
gaaataaaat

SEQ ID NO: 3231 - DNA, 10 bp, Saccharomyces cerevisiae
gaaatatcac

SEQ ID NO: 3232 - DNA, 10 bp, Saccharomyces cerevisiae
gaaatcccac

SEQ ID NO: 3233 - DNA, 10 bp, Saccharomyces cerevisiae
gaaatgtctg

SEQ ID NO: 3234 - DNA, 10 bp, Saccharomyces cerevisiae
gaacggcgaa

SEQ ID NO: 3235 - DNA, 10 bp, Saccharomyces cerevisiae
gaactgtgcg

SEQ ID NO: 3236 - DNA, 10 bp, Saccharomyces cerevisiae
gaacttattg

SEQ ID NO: 3237 - DNA, 10 bp, Saccharomyces cerevisiae
gaagaaatgg

SEQ ID NO: 3238 - DNA, 10 bp, Saccharomyces cerevisiae
gaagaggcgg

SEQ ID NO: 3239 - DNA, 10 bp, Saccharomyces cerevisiae
gaagatttac

SEQ ID NO: 3240 - DNA, 10 bp, Saccharomyces cerevisiae
gaaggaagaa

SEQ ID NO: 3241 - DNA, 10 bp, Saccharomyces cerevisiae
gaatatgaaa

SEQ ID NO: 3242 - DNA, 10 bp, Saccharomyces cerevisiae
gaatcgtggg

SEQ ID NO: 3243 - DNA, 10 bp, Saccharomyces cerevisiae
gaatgtgaaa

SEQ ID NO: 3244 - DNA, 10 bp, Saccharomyces cerevisiae
gaattaaaga

SEQ ID NO: 3245 - DNA, 10 bp, Saccharomyces cerevisiae
gaattgtact

SEQ ID NO: 3246 - DNA, 10 bp, Saccharomyces cerevisiae
gacaagtgcg

SEQ ID NO: 3247 - DNA, 10 bp, Saccharomyces cerevisiae
gacagatacg

SEQ ID NO: 3248 - DNA, 10 bp, Saccharomyces cerevisiae
gacagcgctt

SEQ ID NO: 3249 - DNA, 10 bp, Saccharomyces cerevisiae
gaccactcct

SEQ ID NO: 3250 - DNA, 10 bp, Saccharomyces cerevisiae
gaccgggaaa

SEQ ID NO: 3251 - DNA, 10 bp, Saccharomyces cerevisiae
gaccttgatt

SEQ ID NO: 3252 - DNA, 10 bp, Saccharomyces cerevisiae
gactcacttg

SEQ ID NO: 3253 - DNA, 10 bp, Saccharomyces cerevisiae
gactgactta

SEQ ID NO: 3254 - DNA, 10 bp, Saccharomyces cerevisiae
gacttgtttt

SEQ ID NO: 3255 - DNA, 10 bp, Saccharomyces cerevisiae
gagaagaaaa

SEQ ID NO: 3256 - DNA, 10 bp, Saccharomyces cerevisiae
gagaccaatt

SEQ ID NO: 3257 - DNA, 10 bp, Saccharomyces cerevisiae
gagagatttt

SEQ ID NO: 3258 - DNA, 10 bp, Saccharomyces cerevisiae
gagagtgttg

SEQ ID NO: 3259 - DNA, 10 bp, Saccharomyces cerevisiae
gagatacttt

SEQ ID NO: 3260 - DNA, 10 bp, Saccharomyces cerevisiae
gagatcattt

SEQ ID NO: 3261 - DNA, 10 bp, Saccharomyces cerevisiae
gagcccactt

SEQ ID NO: 3262 - DNA, 10 bp, Saccharomyces cerevisiae
gagctctggc

SEQ ID NO: 3263 - DNA, 10 bp, Saccharomyces cerevisiae
gagcttggga

SEQ ID NO: 3264 - DNA, 10 bp, Saccharomyces cerevisiae
gaggccccag

SEQ ID NO: 3265 - DNA, 10 bp, Saccharomyces cerevisiae
gagggaattt

SEQ ID NO: 3266 - DNA, 10 bp, Saccharomyces cerevisiae
gaggtctaag

SEQ ID NO: 3267 - DNA, 10 bp, Saccharomyces cerevisiae
gaggtgtttt

SEQ ID NO: 3268 - DNA, 10 bp, Saccharomyces cerevisiae
gagtgatgaa

SEQ ID NO: 3269 - DNA, 10 bp, Saccharomyces cerevisiae
gagtggttca

SEQ ID NO: 3270 - DNA, 10 bp, Saccharomyces cerevisiae
gagttacgta

SEQ ID NO: 3271 - DNA, 10 bp, Saccharomyces cerevisiae
gataaactgc

SEQ ID NO: 3272 - DNA, 10 bp, Saccharomyces cerevisiae
gataaccttc

SEQ ID NO: 3273 - DNA, 10 bp, Saccharomyces cerevisiae
gatatgtacc

SEQ ID NO: 3274 - DNA, 10 bp, Saccharomyces cerevisiae
gatattacgg

SEQ ID NO: 3275 - DNA, 10 bp, Saccharomyces cerevisiae
gatcagacgc

SEQ ID NO: 3276 - DNA, 10 bp, Saccharomyces cerevisiae
gatcagtata

SEQ ID NO: 3277 - DNA, 10 bp, Saccharomyces cerevisiae
gatcatccgg

SEQ ID NO: 3278 - DNA, 10 bp, Saccharomyces cerevisiae
gatccatcga

SEQ ID NO: 3279 - DNA, 10 bp, Saccharomyces cerevisiae
gatgaaaata

SEQ ID NO: 3280 - DNA, 10 bp, Saccharomyces cerevisiae
gatgaaggtg

SEQ ID NO: 3281 - DNA, 10 bp, Saccharomyces cerevisiae
gatgaattct

SEQ ID NO: 3282 - DNA, 10 bp, Saccharomyces cerevisiae
gatgatgggt

SEQ ID NO: 3283 - DNA, 10 bp, Saccharomyces cerevisiae
gattcaccag

SEQ ID NO: 3284 - DNA, 10 bp, Saccharomyces cerevisiae
gattcagaaa

SEQ ID NO: 3285 - DNA, 10 bp, Saccharomyces cerevisiae
gatttatttg

SEQ ID NO: 3286 - DNA, 10 bp, Saccharomyces cerevisiae
gcaaatccaa

SEQ ID NO: 3287 - DNA, 10 bp, Saccharomyces cerevisiae
gcaacaccac

SEQ ID NO: 3288 - DNA, 10 bp, Saccharomyces cerevisiae
gcaacttatc

SEQ ID NO: 3289 - DNA, 10 bp, Saccharomyces cerevisiae
gcacaccgtg

SEQ ID NO: 3290 - DNA, 10 bp, Saccharomyces cerevisiae
gcagaagaac

SEQ ID NO: 3291 - DNA, 10 bp, Saccharomyces cerevisiae
gcagatgctg

SEQ ID NO: 3292 - DNA, 10 bp, Saccharomyces cerevisiae
gcaggttgta

SEQ ID NO: 3293 - DNA, 10 bp, Saccharomyces cerevisiae
gcataaatcg

SEQ ID NO: 3294 - DNA, 10 bp, Saccharomyces cerevisiae
gcatagagaa

SEQ ID NO: 3295 - DNA, 10 bp, Saccharomyces cerevisiae
gcatagatat

SEQ ID NO: 3296 - DNA, 10 bp, Saccharomyces cerevisiae
gcattcaaaa

SEQ ID NO: 3297 - DNA, 10 bp, Saccharomyces cerevisiae
gccaccgtcc

SEQ ID NO: 3298 - DNA, 10 bp, Saccharomyces cerevisiae
gccataagtg

SEQ ID NO: 3299 - DNA, 10 bp, Saccharomyces cerevisiae
gcccaatacc

SEQ ID NO: 3300 - DNA, 10 bp, Saccharomyces cerevisiae
gcccatctac

SEQ ID NO: 3301 - DNA, 10 bp, Saccharomyces cerevisiae
gcccgtaacg

SEQ ID NO: 3302 - DNA, 10 bp, Saccharomyces cerevisiae
gccctattaa

SEQ ID NO: 3303 - DNA, 10 bp, Saccharomyces cerevisiae
gccgtgcagc

SEQ ID NO: 3304 - DNA, 10 bp, Saccharomyces cerevisiae
gccgttcgat

SEQ ID NO: 3305 - DNA, 10 bp, Saccharomyces cerevisiae
gccttgaata

SEQ ID NO: 3306 - DNA, 10 bp, Saccharomyces cerevisiae
gccttggtga

SEQ ID NO: 3307 - DNA, 10 bp, Saccharomyces cerevisiae
gcgaaaaaaa

SEQ ID NO: 3308 - DNA, 10 bp, Saccharomyces cerevisiae
gcgagtttag

SEQ ID NO: 3309 - DNA, 10 bp, Saccharomyces cerevisiae
gcgcaggggc

SEQ ID NO: 3310 - DNA, 10 bp, Saccharomyces cerevisiae
gcgtttgagg

SEQ ID NO: 3311 - DNA, 10 bp, Saccharomyces cerevisiae
gctaaaagat

SEQ ID NO: 3312 - DNA, 10 bp, Saccharomyces cerevisiae
gctatgagtt

SEQ ID NO: 3313 - DNA, 10 bp, Saccharomyces cerevisiae
gctcatagaa

SEQ ID NO: 3314 - DNA, 10 bp, Saccharomyces cerevisiae
gctccaatag

SEQ ID NO: 3315 - DNA, 10 bp, Saccharomyces cerevisiae
gctgctaaga

SEQ ID NO: 3316 - DNA, 10 bp, Saccharomyces cerevisiae
gctgctcaag

SEQ ID NO: 3317 - DNA, 10 bp, Saccharomyces cerevisiae
gctgttaacg

SEQ ID NO: 3318 - DNA, 10 bp, Saccharomyces cerevisiae
gcttcaacgg

SEQ ID NO: 3319 - DNA, 10 bp, Saccharomyces cerevisiae
gcttgttgcc

SEQ ID NO: 3320 - DNA, 10 bp, Saccharomyces cerevisiae
gctttttggt

SEQ ID NO: 3321 - DNA, 10 bp, Saccharomyces cerevisiae
ggaaaacaag

SEQ ID NO: 3322 - DNA, 10 bp, Saccharomyces cerevisiae
ggaaacatct

SEQ ID NO: 3323 - DNA, 10 bp, Saccharomyces cerevisiae
ggaaatcaat

SEQ ID NO: 3324 - DNA, 10 bp, Saccharomyces cerevisiae
ggaacataac

SEQ ID NO: 3325 - DNA, 10 bp, Saccharomyces cerevisiae
ggaatacgat

SEQ ID NO: 3326 - DNA, 10 bp, Saccharomyces cerevisiae
ggaataggac

SEQ ID NO: 3327 - DNA, 10 bp, Saccharomyces cerevisiae
ggaatcttga

SEQ ID NO: 3328 - DNA, 10 bp, Saccharomyces cerevisiae
ggaattatga

SEQ ID NO: 3329 - DNA, 10 bp, Saccharomyces cerevisiae
ggacacttct

SEQ ID NO: 3330 - DNA, 10 bp, Saccharomyces cerevisiae
ggacggtctc

SEQ ID NO: 3331 - DNA, 10 bp, Saccharomyces cerevisiae
ggagaagttc

SEQ ID NO: 3332 - DNA, 10 bp, Saccharomyces cerevisiae
ggagaggtct

SEQ ID NO: 3333 - DNA, 10 bp, Saccharomyces cerevisiae
ggatgccaac

SEQ ID NO: 3334 - DNA, 10 bp, Saccharomyces cerevisiae
ggcaagaaga

SEQ ID NO: 3335 - DNA, 10 bp, Saccharomyces cerevisiae
ggcaaggttg

SEQ ID NO: 3336 - DNA, 10 bp, Saccharomyces cerevisiae
ggcaatggca

SEQ ID NO: 3337 - DNA, 10 bp, Saccharomyces cerevisiae
ggcatttgtc

SEQ ID NO: 3338 - DNA, 10 bp, Saccharomyces cerevisiae
ggccatactg

SEQ ID NO: 3339 - DNA, 10 bp, Saccharomyces cerevisiae
ggcccattac

SEQ ID NO: 3340 - DNA, 10 bp, Saccharomyces cerevisiae
ggcgttaacg

SEQ ID NO: 3341 - DNA, 10 bp, Saccharomyces cerevisiae
ggcgttgtgt

SEQ ID NO: 3342 - DNA, 10 bp, Saccharomyces cerevisiae
ggctctggtt

SEQ ID NO: 3343 - DNA, 10 bp, Saccharomyces cerevisiae
ggctgcgtcg

SEQ ID NO: 3344 - DNA, 10 bp, Saccharomyces cerevisiae
ggcttcaaga

SEQ ID NO: 3345 - DNA, 10 bp, Saccharomyces cerevisiae
ggctttgtac

SEQ ID NO: 3346 - DNA, 10 bp, Saccharomyces cerevisiae
gggattttgg

SEQ ID NO: 3347 - DNA, 10 bp, Saccharomyces cerevisiae
gggcaatttt

SEQ ID NO: 3348 - DNA, 10 bp, Saccharomyces cerevisiae
gggcagctcg

SEQ ID NO: 3349 - DNA, 10 bp, Saccharomyces cerevisiae
gggtccagat

SEQ ID NO: 3350 - DNA, 10 bp, Saccharomyces cerevisiae
gggtgaaaac

SEQ ID NO: 3351 - DNA, 10 bp, Saccharomyces cerevisiae
gggtgaaaag

SEQ ID NO: 3352 - DNA, 10 bp, Saccharomyces cerevisiae
gggttacagg

SEQ ID NO: 3353 - DNA, 10 bp, Saccharomyces cerevisiae
gggttcggtt

SEQ ID NO: 3354 - DNA, 10 bp, Saccharomyces cerevisiae
ggtaaaaacg

SEQ ID NO: 3355 - DNA, 10 bp, Saccharomyces cerevisiae
ggtaggtaag

SEQ ID NO: 3356 - DNA, 10 bp, Saccharomyces cerevisiae
ggtccagctc

SEQ ID NO: 3357 - DNA, 10 bp, Saccharomyces cerevisiae
ggtctcaggt

SEQ ID NO: 3358 - DNA, 10 bp, Saccharomyces cerevisiae
ggtgaaaacc

SEQ ID NO: 3359 - DNA, 10 bp, Saccharomyces cerevisiae
ggtgaaagcg

SEQ ID NO: 3360 - DNA, 10 bp, Saccharomyces cerevisiae
ggtgaccaaa

SEQ ID NO: 3361 - DNA, 10 bp, Saccharomyces cerevisiae
ggtgataaat

SEQ ID NO: 3362 - DNA, 10 bp, Saccharomyces cerevisiae
ggtgctgtgt

SEQ ID NO: 3363 - DNA, 10 bp, Saccharomyces cerevisiae
ggtggaaacg

SEQ ID NO: 3364 - DNA, 10 bp, Saccharomyces cerevisiae
ggtggccagc

SEQ ID NO: 3365 - DNA, 10 bp, Saccharomyces cerevisiae
ggtggtccaa

SEQ ID NO: 3366 - DNA, 10 bp, Saccharomyces cerevisiae
ggtgtaaacg

SEQ ID NO: 3367 - DNA, 10 bp, Saccharomyces cerevisiae
ggtgttaact

SEQ ID NO: 3368 - DNA, 10 bp, Saccharomyces cerevisiae
ggtgttaatg

SEQ ID NO: 3369 - DNA, 10 bp, Saccharomyces cerevisiae
ggtgttttta

SEQ ID NO: 3370 - DNA, 10 bp, Saccharomyces cerevisiae
ggttacggtt

SEQ ID NO: 3371 - DNA, 10 bp, Saccharomyces cerevisiae
ggttccggta

SEQ ID NO: 3372 - DNA, 10 bp, Saccharomyces cerevisiae
ggttcggttt

SEQ ID NO: 3373 - DNA, 10 bp, Saccharomyces cerevisiae
ggttgtgtta

SEQ ID NO: 3374 - DNA, 10 bp, Saccharomyces cerevisiae
ggtttccggt

SEQ ID NO: 3375 - DNA, 10 bp, Saccharomyces cerevisiae
ggtttcctga

SEQ ID NO: 3376 - DNA, 10 bp, Saccharomyces cerevisiae
ggtttccttc

SEQ ID NO: 3377 - DNA, 10 bp, Saccharomyces cerevisiae
ggtttcggtc

SEQ ID NO: 3378 - DNA, 10 bp, Saccharomyces cerevisiae
ggttttaaag

SEQ ID NO: 3379 - DNA, 10 bp, Saccharomyces cerevisiae
ggttttggct

SEQ ID NO: 3380 - DNA, 10 bp, Saccharomyces cerevisiae
gtaaaagaat

SEQ ID NO: 3381 - DNA, 10 bp, Saccharomyces cerevisiae
gtaacgaatc

SEQ ID NO: 3382 - DNA, 10 bp, Saccharomyces cerevisiae
gtaagattga

SEQ ID NO: 3383 - DNA, 10 bp, Saccharomyces cerevisiae
gtacagctat

SEQ ID NO: 3384 - DNA, 10 bp, Saccharomyces cerevisiae
gtacctaccc

SEQ ID NO: 3385 - DNA, 10 bp, Saccharomyces cerevisiae
gtactccagc

SEQ ID NO: 3386 - DNA, 10 bp, Saccharomyces cerevisiae
gtagctacag

SEQ ID NO: 3387 - DNA, 10 bp, Saccharomyces cerevisiae
gtagtattag

SEQ ID NO: 3388 - DNA, 10 bp, Saccharomyces cerevisiae
gtatagcaaa

SEQ ID NO: 3389 - DNA, 10 bp, Saccharomyces cerevisiae
gtatcgaaaa

SEQ ID NO: 3390 - DNA, 10 bp, Saccharomyces cerevisiae
gtatttttca

SEQ ID NO: 3391 - DNA, 10 bp, Saccharomyces cerevisiae
gtcagattct

SEQ ID NO: 3392 - DNA, 10 bp, Saccharomyces cerevisiae
gtccataagc

SEQ ID NO: 3393 - DNA, 10 bp, Saccharomyces cerevisiae
gtcgccgctc

SEQ ID NO: 3394 - DNA, 10 bp, Saccharomyces cerevisiae
gtcggactgc

SEQ ID NO: 3395 - DNA, 10 bp, Saccharomyces cerevisiae
gtctcgcttg

SEQ ID NO: 3396 - DNA, 10 bp, Saccharomyces cerevisiae
gtctttcttt

SEQ ID NO: 3397 - DNA, 10 bp, Saccharomyces cerevisiae
gtcttttcac

SEQ ID NO: 3398 - DNA, 10 bp, Saccharomyces cerevisiae
gtgaaaaaaa

SEQ ID NO: 3399 - DNA, 10 bp, Saccharomyces cerevisiae
gtgaaagcga

SEQ ID NO: 3400 - DNA, 10 bp, Saccharomyces cerevisiae
gtgagcagtc

SEQ ID NO: 3401 - DNA, 10 bp, Saccharomyces cerevisiae
gtgcgtgttc

SEQ ID NO: 3402 - DNA, 10 bp, Saccharomyces cerevisiae
gtgcttcttt

SEQ ID NO: 3403 - DNA, 10 bp, Saccharomyces cerevisiae
gtggagattt

SEQ ID NO: 3404 - DNA, 10 bp, Saccharomyces cerevisiae
gtggctactc

SEQ ID NO: 3405 - DNA, 10 bp, Saccharomyces cerevisiae
gtggctactt

SEQ ID NO: 3406 - DNA, 10 bp, Saccharomyces cerevisiae
gtggtattgc

SEQ ID NO: 3407 - DNA, 10 bp, Saccharomyces cerevisiae
gtggtttttc

SEQ ID NO: 3408 - DNA, 10 bp, Saccharomyces cerevisiae
gtgtcagttt

SEQ ID NO: 3409 - DNA, 10 bp, Saccharomyces cerevisiae
gtgtggtcct

SEQ ID NO: 3410 - DNA, 10 bp, Saccharomyces cerevisiae
gttaaaaaaa

SEQ ID NO: 3411 - DNA, 10 bp, Saccharomyces cerevisiae
gttaaatttt

SEQ ID NO: 3412 - DNA, 10 bp, Saccharomyces cerevisiae
gttatatgct

SEQ ID NO: 3413 - DNA, 10 bp, Saccharomyces cerevisiae
gttatattga

SEQ ID NO: 3414 - DNA, 10 bp, Saccharomyces cerevisiae
gttcaagagg

SEQ ID NO: 3415 - DNA, 10 bp, Saccharomyces cerevisiae
gttccaaagc

SEQ ID NO: 3416 - DNA, 10 bp, Saccharomyces cerevisiae
gttccaacct

SEQ ID NO: 3417 - DNA, 10 bp, Saccharomyces cerevisiae
gttcctggct

SEQ ID NO: 3418 - DNA, 10 bp, Saccharomyces cerevisiae
gttcgaaaac

SEQ ID NO: 3419 - DNA, 10 bp, Saccharomyces cerevisiae
gttgatgaca

SEQ ID NO: 3420 - DNA, 10 bp, Saccharomyces cerevisiae
gttgttgaaa

SEQ ID NO: 3421 - DNA, 10 bp, Saccharomyces cerevisiae
gtttacaaac

SEQ ID NO: 3422 - DNA, 10 bp, Saccharomyces cerevisiae
gtttctataa

SEQ ID NO: 3423 - DNA, 10 bp, Saccharomyces cerevisiae
gtttcttgcc

SEQ ID NO: 3424 - DNA, 10 bp, Saccharomyces cerevisiae
gtttgacacc

SEQ ID NO: 3425 - DNA, 10 bp, Saccharomyces cerevisiae
gttttccttt

SEQ ID NO: 3426 - DNA, 10 bp, Saccharomyces cerevisiae
taaaatacta

SEQ ID NO: 3427 - DNA, 10 bp, Saccharomyces cerevisiae
taaacggccg

SEQ ID NO: 3428 - DNA, 10 bp, Saccharomyces cerevisiae
taaataattt

SEQ ID NO: 3429 - DNA, 10 bp, Saccharomyces cerevisiae
taaatatata

SEQ ID NO: 3430 - DNA, 10 bp, Saccharomyces cerevisiae
taaatctgag

SEQ ID NO: 3431 - DNA, 10 bp, Saccharomyces cerevisiae
taaatttaac

SEQ ID NO: 3432 - DNA, 10 bp, Saccharomyces cerevisiae
taacccttaa

SEQ ID NO: 3433 - DNA, 10 bp, Saccharomyces cerevisiae
taaccttaca

SEQ ID NO: 3434 - DNA, 10 bp, Saccharomyces cerevisiae
taactagcgt

SEQ ID NO: 3435 - DNA, 10 bp, Saccharomyces cerevisiae
taactggaag

SEQ ID NO: 3436 - DNA, 10 bp, Saccharomyces cerevisiae
taagtatttg

SEQ ID NO: 3437 - DNA, 10 bp, Saccharomyces cerevisiae
taatgaatct

SEQ ID NO: 3438 - DNA, 10 bp, Saccharomyces cerevisiae
taattagtta

SEQ ID NO: 3439 - DNA, 10 bp, Saccharomyces cerevisiae
tacaagaaaa

SEQ ID NO: 3440 - DNA, 10 bp, Saccharomyces cerevisiae
tacaggtctt

SEQ ID NO: 3441 - DNA, 10 bp, Saccharomyces cerevisiae
tacatacaaa

SEQ ID NO: 3442 - DNA, 10 bp, Saccharomyces cerevisiae
tacatatttt

SEQ ID NO: 3443 - DNA, 10 bp, Saccharomyces cerevisiae
taccaccacg

SEQ ID NO: 3444 - DNA, 10 bp, Saccharomyces cerevisiae
taccaccctt

SEQ ID NO: 3445 - DNA, 10 bp, Saccharomyces cerevisiae
taccagaaaa

SEQ ID NO: 3446 - DNA, 10 bp, Saccharomyces cerevisiae
taccctcctt

SEQ ID NO: 3447 - DNA, 10 bp, Saccharomyces cerevisiae
taccgctcct

SEQ ID NO: 3448 - DNA, 10 bp, Saccharomyces cerevisiae
tacctctcag

SEQ ID NO: 3449 - DNA, 10 bp, Saccharomyces cerevisiae
tactaagaaa

SEQ ID NO: 3450 - DNA, 10 bp, Saccharomyces cerevisiae
tactttaaat

SEQ ID NO: 3451 - DNA, 10 bp, Saccharomyces cerevisiae
tagaacaaga

SEQ ID NO: 3452 - DNA, 10 bp, Saccharomyces cerevisiae
tagagaatgt

SEQ ID NO: 3453 - DNA, 10 bp, Saccharomyces cerevisiae
tagcagaaat

SEQ ID NO: 3454 - DNA, 10 bp, Saccharomyces cerevisiae
tagccaatgc

SEQ ID NO: 3455 - DNA, 10 bp, Saccharomyces cerevisiae
tagccacccc

SEQ ID NO: 3456 - DNA, 10 bp, Saccharomyces cerevisiae
tagctatcag

SEQ ID NO: 3457 - DNA, 10 bp, Saccharomyces cerevisiae
tagggaacta

SEQ ID NO: 3458 - DNA, 10 bp, Saccharomyces cerevisiae
tagggccctc

SEQ ID NO: 3459 - DNA, 10 bp, Saccharomyces cerevisiae
taggtttttt

SEQ ID NO: 3460 - DNA, 10 bp, Saccharomyces cerevisiae
tagtcaagcc

SEQ ID NO: 3461 - DNA, 10 bp, Saccharomyces cerevisiae
tagttagttt

SEQ ID NO: 3462 - DNA, 10 bp, Saccharomyces cerevisiae
tagtttattt

SEQ ID NO: 3463 - DNA, 10 bp, Saccharomyces cerevisiae
tataaagtaa

SEQ ID NO: 3464 - DNA, 10 bp, Saccharomyces cerevisiae
tataaatgta

SEQ ID NO: 3465 - DNA, 10 bp, Saccharomyces cerevisiae
tataatgcta

SEQ ID NO: 3466 - DNA, 10 bp, Saccharomyces cerevisiae
tatataaata

SEQ ID NO: 3467 - DNA, 10 bp, Saccharomyces cerevisiae
tatatagagt

SEQ ID NO: 3468 - DNA, 10 bp, Saccharomyces cerevisiae
tatatataat

SEQ ID NO: 3469 - DNA, 10 bp, Saccharomyces cerevisiae
tatatcgtat

SEQ ID NO: 3470 - DNA, 10 bp, Saccharomyces cerevisiae
tatatgtgtg

SEQ ID NO: 3471 - DNA, 10 bp, Saccharomyces cerevisiae
tatattaagg

SEQ ID NO: 3472 - DNA, 10 bp, Saccharomyces cerevisiae
tatattggac

SEQ ID NO: 3473 - DNA, 10 bp, Saccharomyces cerevisiae
tatattttta

SEQ ID NO: 3474 - DNA, 10 bp, Saccharomyces cerevisiae
tatctagaga

SEQ ID NO: 3475 - DNA, 10 bp, Saccharomyces cerevisiae
tatcttttca

SEQ ID NO: 3476 - DNA, 10 bp, Saccharomyces cerevisiae
tatgatgtga

SEQ ID NO: 3477 - DNA, 10 bp, Saccharomyces cerevisiae
tattactgac

SEQ ID NO: 3478 - DNA, 10 bp, Saccharomyces cerevisiae
tattctgtat

SEQ ID NO: 3479 - DNA, 10 bp, Saccharomyces cerevisiae
tattgtttta

SEQ ID NO: 3480 - DNA, 10 bp, Saccharomyces cerevisiae
tatttataat

SEQ ID NO: 3481 - DNA, 10 bp, Saccharomyces cerevisiae
tatttattta

SEQ ID NO: 3482 - DNA, 10 bp, Saccharomyces cerevisiae
tatttgatga

SEQ ID NO: 3483 - DNA, 10 bp, Saccharomyces cerevisiae
tatttggatg

SEQ ID NO: 3484 - DNA, 10 bp, Saccharomyces cerevisiae
tattttatat

SEQ ID NO: 3485 - DNA, 10 bp, Saccharomyces cerevisiae
tattttcagg

SEQ ID NO: 3486 - DNA, 10 bp, Saccharomyces cerevisiae
tatttttatt

SEQ ID NO: 3487 - DNA, 10 bp, Saccharomyces cerevisiae
tcaaaagaag

SEQ ID NO: 3488 - DNA, 10 bp, Saccharomyces cerevisiae
tcaaacagtt

SEQ ID NO: 3489 - DNA, 10 bp, Saccharomyces cerevisiae
tcaaaggatc

SEQ ID NO: 3490 - DNA, 10 bp, Saccharomyces cerevisiae
tcaaatagat

SEQ ID NO: 3491 - DNA, 10 bp, Saccharomyces cerevisiae
tcaaattttt

SEQ ID NO: 3492 - DNA, 10 bp, Saccharomyces cerevisiae
tcactattaa

SEQ ID NO: 3493 - DNA, 10 bp, Saccharomyces cerevisiae
tcatagctta

SEQ ID NO: 3494 - DNA, 10 bp, Saccharomyces cerevisiae
tcatattata

SEQ ID NO: 3495 - DNA, 10 bp, Saccharomyces cerevisiae
tcatcaccag

SEQ ID NO: 3496 - DNA, 10 bp, Saccharomyces cerevisiae
tccaactttg

SEQ ID NO: 3497 - DNA, 10 bp, Saccharomyces cerevisiae
tccattatgc

SEQ ID NO: 3498 - DNA, 10 bp, Saccharomyces cerevisiae
tccatttatc

SEQ ID NO: 3499 - DNA, 10 bp, Saccharomyces cerevisiae
tccccgtaaa

SEQ ID NO: 3500 - DNA, 10 bp, Saccharomyces cerevisiae
tccccgtacc

SEQ ID NO: 3501 - DNA, 10 bp, Saccharomyces cerevisiae
tcccctatta

SEQ ID NO: 3502 - DNA, 10 bp, Saccharomyces cerevisiae
tccctactaa

SEQ ID NO: 3503 - DNA, 10 bp, Saccharomyces cerevisiae
tccctactgg

SEQ ID NO: 3504 - DNA, 10 bp, Saccharomyces cerevisiae
tccctattat

SEQ ID NO: 3505 - DNA, 10 bp, Saccharomyces cerevisiae
tccctttaag

SEQ ID NO: 3506 - DNA, 10 bp, Saccharomyces cerevisiae
tcctcagcta

SEQ ID NO: 3507 - DNA, 10 bp, Saccharomyces cerevisiae
tcctccggag

SEQ ID NO: 3508 - DNA, 10 bp, Saccharomyces cerevisiae
tcgccactaa

SEQ ID NO: 3509 - DNA, 10 bp, Saccharomyces cerevisiae
tcgccgagga

SEQ ID NO: 3510 - DNA, 10 bp, Saccharomyces cerevisiae
tcgcctcagg

SEQ ID NO: 3511 - DNA, 10 bp, Saccharomyces cerevisiae
tcgcctgaag

SEQ ID NO: 3512 - DNA, 10 bp, Saccharomyces cerevisiae
tcggtgtatt

SEQ ID NO: 3513 - DNA, 10 bp, Saccharomyces cerevisiae
tcgtcatcag

SEQ ID NO: 3514 - DNA, 10 bp, Saccharomyces cerevisiae
tcgtctggtt

SEQ ID NO: 3515 - DNA, 10 bp, Saccharomyces cerevisiae
tcgttgaagt

SEQ ID NO: 3516 - DNA, 10 bp, Saccharomyces cerevisiae
tctagtcgaa

SEQ ID NO: 3517 - DNA, 10 bp, Saccharomyces cerevisiae
tctatagcaa

SEQ ID NO: 3518 - DNA, 10 bp, Saccharomyces cerevisiae
tctctaccgg

SEQ ID NO: 3519 - DNA, 10 bp, Saccharomyces cerevisiae
tctctactgt

SEQ ID NO: 3520 - DNA, 10 bp, Saccharomyces cerevisiae
tctgcagagc

SEQ ID NO: 3521 - DNA, 10 bp, Saccharomyces cerevisiae
tcttcgttat

SEQ ID NO: 3522 - DNA, 10 bp, Saccharomyces cerevisiae
tgaatgaaac

SEQ ID NO: 3523 - DNA, 10 bp, Saccharomyces cerevisiae
tgacaagtat

SEQ ID NO: 3524 - DNA, 10 bp, Saccharomyces cerevisiae
tgagagagat

SEQ ID NO: 3525 - DNA, 10 bp, Saccharomyces cerevisiae
tgagcactcc

SEQ ID NO: 3526 - DNA, 10 bp, Saccharomyces cerevisiae
tgaggcagtt

SEQ ID NO: 3527 - DNA, 10 bp, Saccharomyces cerevisiae
tgatccaaag

SEQ ID NO: 3528 - DNA, 10 bp, Saccharomyces cerevisiae
tgatgacatt

SEQ ID NO: 3529 - DNA, 10 bp, Saccharomyces cerevisiae
tgatgcccaa

SEQ ID NO: 3530 - DNA, 10 bp, Saccharomyces cerevisiae
tgatttcatt

SEQ ID NO: 3531 - DNA, 10 bp, Saccharomyces cerevisiae
tgcccgttgt

SEQ ID NO: 3532 - DNA, 10 bp, Saccharomyces cerevisiae
tgccgtttcc

SEQ ID NO: 3533 - DNA, 10 bp, Saccharomyces cerevisiae
tgctagttta

SEQ ID NO: 3534 - DNA, 10 bp, Saccharomyces cerevisiae
tgctatacat

SEQ ID NO: 3535 - DNA, 10 bp, Saccharomyces cerevisiae
tgctcttctt

SEQ ID NO: 3536 - DNA, 10 bp, Saccharomyces cerevisiae
tggatgtgta

SEQ ID NO: 3537 - DNA, 10 bp, Saccharomyces cerevisiae
tggattttta

SEQ ID NO: 3538 - DNA, 10 bp, Saccharomyces cerevisiae
tggccaatcc

SEQ ID NO: 3539 - DNA, 10 bp, Saccharomyces cerevisiae
tggctacgtc

SEQ ID NO: 3540 - DNA, 10 bp, Saccharomyces cerevisiae
tgggaaatgt

SEQ ID NO: 3541 - DNA, 10 bp, Saccharomyces cerevisiae
tgggttgaag

SEQ ID NO: 3542 - DNA, 10 bp, Saccharomyces cerevisiae
tggtacaagg

SEQ ID NO: 3543 - DNA, 10 bp, Saccharomyces cerevisiae
tggtgaagct

SEQ ID NO: 3544 - DNA, 10 bp, Saccharomyces cerevisiae
tggtgtcatt

SEQ ID NO: 3545 - DNA, 10 bp, Saccharomyces cerevisiae
tgtaacaatg

SEQ ID NO: 3546 - DNA, 10 bp, Saccharomyces cerevisiae
tgtaacttaa

SEQ ID NO: 3547 - DNA, 10 bp, Saccharomyces cerevisiae
tgtacagacg

SEQ ID NO: 3548 - DNA, 10 bp, Saccharomyces cerevisiae
tgtattgtta

SEQ ID NO: 3549 - DNA, 10 bp, Saccharomyces cerevisiae
tgtccaattc

SEQ ID NO: 3550 - DNA, 10 bp, Saccharomyces cerevisiae
tgtctaccaa

SEQ ID NO: 3551 - DNA, 10 bp, Saccharomyces cerevisiae
tgtctggtgt

SEQ ID NO: 3552 - DNA, 10 bp, Saccharomyces cerevisiae
tgtggtatat

SEQ ID NO: 3553 - DNA, 10 bp, Saccharomyces cerevisiae
tgttacgtaa

SEQ ID NO: 3554 - DNA, 10 bp, Saccharomyces cerevisiae
tgttcttcat

SEQ ID NO: 3555 - DNA, 10 bp, Saccharomyces cerevisiae
tgtttataaa

SEQ ID NO: 3556 - DNA, 10 bp, Saccharomyces cerevisiae
tgtttgaagg

SEQ ID NO: 3557 - DNA, 10 bp, Saccharomyces cerevisiae
ttaacacaaa

SEQ ID NO: 3558 - DNA, 10 bp, Saccharomyces cerevisiae
ttaacctata

SEQ ID NO: 3559 - DNA, 10 bp, Saccharomyces cerevisiae
ttaagtttcg

SEQ ID NO: 3560 - DNA, 10 bp, Saccharomyces cerevisiae
ttaattatct

SEQ ID NO: 3561 - DNA, 10 bp, Saccharomyces cerevisiae
ttaccacttc

SEQ ID NO: 3562 - DNA, 10 bp, Saccharomyces cerevisiae
ttactaagga

SEQ ID NO: 3563 - DNA, 10 bp, Saccharomyces cerevisiae
ttagaatgca

SEQ ID NO: 3564 - DNA, 10 bp, Saccharomyces cerevisiae
ttagagattg

SEQ ID NO: 3565 - DNA, 10 bp, Saccharomyces cerevisiae
ttaggaagcg

SEQ ID NO: 3566 - DNA, 10 bp, Saccharomyces cerevisiae
ttagggcata

SEQ ID NO: 3567 - DNA, 10 bp, Saccharomyces cerevisiae
ttagttccta

SEQ ID NO: 3568 - DNA, 10 bp, Saccharomyces cerevisiae
ttagtttcca

SEQ ID NO: 3569 - DNA, 10 bp, Saccharomyces cerevisiae
ttagtttctg

SEQ ID NO: 3570 - DNA, 10 bp, Saccharomyces cerevisiae
ttatataaaa

SEQ ID NO: 3571 - DNA, 10 bp, Saccharomyces cerevisiae
ttatatggtg

SEQ ID NO: 3572 - DNA, 10 bp, Saccharomyces cerevisiae
ttatttctaa

SEQ ID NO: 3573 - DNA, 10 bp, Saccharomyces cerevisiae
ttcaaaaaca

SEQ ID NO: 3574 - DNA, 10 bp, Saccharomyces cerevisiae
ttcaaaactg

SEQ ID NO: 3575 - DNA, 10 bp, Saccharomyces cerevisiae
ttcataagtt

SEQ ID NO: 3576 - DNA, 10 bp, Saccharomyces cerevisiae
ttccacagga

SEQ ID NO: 3577 - DNA, 10 bp, Saccharomyces cerevisiae
ttcgtaaact

SEQ ID NO: 3578 - DNA, 10 bp, Saccharomyces cerevisiae
ttcgtccact

SEQ ID NO: 3579 - DNA, 10 bp, Saccharomyces cerevisiae
ttctagatgc

SEQ ID NO: 3580 - DNA, 10 bp, Saccharomyces cerevisiae
ttctataatt

SEQ ID NO: 3581 - DNA, 10 bp, Saccharomyces cerevisiae
ttgaactcag

SEQ ID NO: 3582 - DNA, 10 bp, Saccharomyces cerevisiae
ttgaagaaaa

SEQ ID NO: 3583 - DNA, 10 bp, Saccharomyces cerevisiae
ttgaagaaat

SEQ ID NO: 3584 - DNA, 10 bp, Saccharomyces cerevisiae
ttgaagtagt

SEQ ID NO: 3585 - DNA, 10 bp, Saccharomyces cerevisiae
ttgaggattt

SEQ ID NO: 3586 - DNA, 10 bp, Saccharomyces cerevisiae
ttgatgattt

SEQ ID NO: 3587 - DNA, 10 bp, Saccharomyces cerevisiae
ttgattactt

SEQ ID NO: 3588 - DNA, 10 bp, Saccharomyces cerevisiae
ttgcagtctt

SEQ ID NO: 3589 - DNA, 10 bp, Saccharomyces cerevisiae
ttgcctgctt

SEQ ID NO: 3590 - DNA, 10 bp, Saccharomyces cerevisiae
ttgcttcaca

SEQ ID NO: 3591 - DNA, 10 bp, Saccharomyces cerevisiae
ttggataatt

SEQ ID NO: 3592 - DNA, 10 bp, Saccharomyces cerevisiae
ttggccaaga

SEQ ID NO: 3593 - DNA, 10 bp, Saccharomyces cerevisiae
ttgggagcgg

SEQ ID NO: 3594 - DNA, 10 bp, Saccharomyces cerevisiae
ttgtataaag

SEQ ID NO: 3595 - DNA, 10 bp, Saccharomyces cerevisiae
ttgtcaaaaa

SEQ ID NO: 3596 - DNA, 10 bp, Saccharomyces cerevisiae
ttgtcgcacc

SEQ ID NO: 3597 - DNA, 10 bp, Saccharomyces cerevisiae
tttatttgag

SEQ ID NO: 3598 - DNA, 10 bp, Saccharomyces cerevisiae
tttcaaaaaa

SEQ ID NO: 3599 - DNA, 10 bp, Saccharomyces cerevisiae
tttccgattt

SEQ ID NO: 3600 - DNA, 10 bp, Saccharomyces cerevisiae
tttctgctcc

SEQ ID NO: 3601 - DNA, 10 bp, Saccharomyces cerevisiae
tttgaaaaat

SEQ ID NO: 3602 - DNA, 10 bp, Saccharomyces cerevisiae
tttgatttga

SEQ ID NO: 3603 - DNA, 10 bp, Saccharomyces cerevisiae
tttgctcgcg

SEQ ID NO: 3604 - DNA, 10 bp, Saccharomyces cerevisiae
tttggtaaca

SEQ ID NO: 3605 - DNA, 10 bp, Saccharomyces cerevisiae
ttttacaacc

SEQ ID NO: 3606 - DNA, 10 bp, Saccharomyces cerevisiae
ttttcactgg

SEQ ID NO: 3607 - DNA, 10 bp, Saccharomyces cerevisiae
ttttcagatg

SEQ ID NO: 3608 - DNA, 10 bp, Saccharomyces cerevisiae
ttttgttttt

SEQ ID NO: 3609 - DNA, 10 bp, Saccharomyces cerevisiae
tttttataag

SEQ ID NO: 3610 - DNA, 10 bp, Saccharomyces cerevisiae
tttttgccaa

SEQ ID NO: 3611 - DNA, 10 bp, Saccharomyces cerevisiae
tttttggagt

SEQ ID NO: 3612 - DNA, 10 bp, Saccharomyces cerevisiae
ttttttccga

SEQ ID NO: 3613 - DNA, 10 bp, Saccharomyces cerevisiae
aaaaaaaaac

SEQ ID NO: 3614 - DNA, 10 bp, Saccharomyces cerevisiae
aaaaaaactg

SEQ ID NO: 3615 - DNA, 10 bp, Saccharomyces cerevisiae
aaaaaaaggt

SEQ ID NO: 3616 - DNA, 10 bp, Saccharomyces cerevisiae
aaaaaactgc

SEQ ID NO: 3617 - DNA, 10 bp, Saccharomyces cerevisiae
aaaaaagaaa

SEQ ID NO: 3618 - DNA, 10 bp, Saccharomyces cerevisiae
aaaaaagtta

SEQ ID NO: 3619 - DNA, 10 bp, Saccharomyces cerevisiae
aaaaaatcat

SEQ ID NO: 3620 - DNA, 10 bp, Saccharomyces cerevisiae
aaaaagatac

SEQ ID NO: 3621 - DNA, 10 bp, Saccharomyces cerevisiae
aaaaagggtg

SEQ ID NO: 3622 - DNA, 10 bp, Saccharomyces cerevisiae
aaaaatagag

SEQ ID NO: 3623 - DNA, 10 bp, Saccharomyces cerevisiae
aaaaatttat

SEQ ID NO: 3624 - DNA, 10 bp, Saccharomyces cerevisiae
aaaacagaag

SEQ ID NO: 3625 - DNA, 10 bp, Saccharomyces cerevisiae
aaaacgattt

SEQ ID NO: 3626 - DNA, 10 bp, Saccharomyces cerevisiae
aaaagaatcc

SEQ ID NO: 3627 - DNA, 10 bp, Saccharomyces cerevisiae
aaaagaattt

SEQ ID NO: 3628 - DNA, 10 bp, Saccharomyces cerevisiae
aaaagtagtt

SEQ ID NO: 3629 - DNA, 10 bp, Saccharomyces cerevisiae
aaaatacagc

SEQ ID NO: 3630 - DNA, 10 bp, Saccharomyces cerevisiae
aaaatagtga

SEQ ID NO: 3631 - DNA, 10 bp, Saccharomyces cerevisiae
aaaatatctt

SEQ ID NO: 3632 - DNA, 10 bp, Saccharomyces cerevisiae
aaaatgaccg

SEQ ID NO: 3633 - DNA, 10 bp, Saccharomyces cerevisiae
aaaattgttc

SEQ ID NO: 3634 - DNA, 10 bp, Saccharomyces cerevisiae
aaaatttata

SEQ ID NO: 3635 - DNA, 10 bp, Saccharomyces cerevisiae
aaacaaactg

SEQ ID NO: 3636 - DNA, 10 bp, Saccharomyces cerevisiae
aaacaagtgg

SEQ ID NO: 3637 - DNA, 10 bp, Saccharomyces cerevisiae
aaaccagttg

SEQ ID NO: 3638 - DNA, 10 bp, Saccharomyces cerevisiae
aaaccattta

SEQ ID NO: 3639 - DNA, 10 bp, Saccharomyces cerevisiae
aaaccggatg

SEQ ID NO: 3640 - DNA, 10 bp, Saccharomyces cerevisiae
aaaccgtgaa

SEQ ID NO: 3641 - DNA, 10 bp, Saccharomyces cerevisiae
aaacgactgt

SEQ ID NO: 3642 - DNA, 10 bp, Saccharomyces cerevisiae
aaacgtcgca

SEQ ID NO: 3643 - DNA, 10 bp, Saccharomyces cerevisiae
aaactatacc

SEQ ID NO: 3644 - DNA, 10 bp, Saccharomyces cerevisiae
aaactctctg

SEQ ID NO: 3645 - DNA, 10 bp, Saccharomyces cerevisiae
aaactcttga

SEQ ID NO: 3646 - DNA, 10 bp, Saccharomyces cerevisiae
aaagaaaaaa

SEQ ID NO: 3647 - DNA, 10 bp, Saccharomyces cerevisiae
aaagactaaa

SEQ ID NO: 3648 - DNA, 10 bp, Saccharomyces cerevisiae
aaagagcgag

SEQ ID NO: 3649 - DNA, 10 bp, Saccharomyces cerevisiae
aaagatccga

SEQ ID NO: 3650 - DNA, 10 bp, Saccharomyces cerevisiae
aaagatttcg

SEQ ID NO: 3651 - DNA, 10 bp, Saccharomyces cerevisiae
aaagcagagc

SEQ ID NO: 3652 - DNA, 10 bp, Saccharomyces cerevisiae
aaagctgtcg

SEQ ID NO: 3653 - DNA, 10 bp, Saccharomyces cerevisiae
aaagctttag

SEQ ID NO: 3654 - DNA, 10 bp, Saccharomyces cerevisiae
aaaggtcgtt

SEQ ID NO: 3655 - DNA, 10 bp, Saccharomyces cerevisiae
aaagtgctac

SEQ ID NO: 3656 - DNA, 10 bp, Saccharomyces cerevisiae
aaagtttggt

SEQ ID NO: 3657 - DNA, 10 bp, Saccharomyces cerevisiae
aaataaaaaa

SEQ ID NO: 3658 - DNA, 10 bp, Saccharomyces cerevisiae
aaataatttt

SEQ ID NO: 3659 - DNA, 10 bp, Saccharomyces cerevisiae
aaatacgaca

SEQ ID NO: 3660 - DNA, 10 bp, Saccharomyces cerevisiae
aaatcatcta

SEQ ID NO: 3661 - DNA, 10 bp, Saccharomyces cerevisiae
aaatccaatg

SEQ ID NO: 3662 - DNA, 10 bp, Saccharomyces cerevisiae
aaatgagttt

SEQ ID NO: 3663 - DNA, 10 bp, Saccharomyces cerevisiae
aaatgatttg

SEQ ID NO: 3664 - DNA, 10 bp, Saccharomyces cerevisiae
aaattacaaa

SEQ ID NO: 3665 - DNA, 10 bp, Saccharomyces cerevisiae
aaattcaaaa

SEQ ID NO: 3666 - DNA, 10 bp, Saccharomyces cerevisiae
aaattgaatg

SEQ ID NO: 3667 - DNA, 10 bp, Saccharomyces cerevisiae
aaattgcttc

SEQ ID NO: 3668 - DNA, 10 bp, Saccharomyces cerevisiae
aaatttcatt

SEQ ID NO: 3669 - DNA, 10 bp, Saccharomyces cerevisiae
aaatttgggg

SEQ ID NO: 3670 - DNA, 10 bp, Saccharomyces cerevisiae
aacaaaatgg

SEQ ID NO: 3671 - DNA, 10 bp, Saccharomyces cerevisiae
aacaaagttt

SEQ ID NO: 3672 - DNA, 10 bp, Saccharomyces cerevisiae
aacaagaata

SEQ ID NO: 3673 - DNA, 10 bp, Saccharomyces cerevisiae
aacaagactt

SEQ ID NO: 3674 - DNA, 10 bp, Saccharomyces cerevisiae
aacaatccaa

SEQ ID NO: 3675 - DNA, 10 bp, Saccharomyces cerevisiae
aacaattcag

SEQ ID NO: 3676 - DNA, 10 bp, Saccharomyces cerevisiae
aacaattcgc

SEQ ID NO: 3677 - DNA, 10 bp, Saccharomyces cerevisiae
aacacagcca

SEQ ID NO: 3678 - DNA, 10 bp, Saccharomyces cerevisiae
aacacttgtc

SEQ ID NO: 3679 - DNA, 10 bp, Saccharomyces cerevisiae
aacagacaat

SEQ ID NO: 3680 - DNA, 10 bp, Saccharomyces cerevisiae
aacagaccca

SEQ ID NO: 3681 - DNA, 10 bp, Saccharomyces cerevisiae
aacaggctat

SEQ ID NO: 3682 - DNA, 10 bp, Saccharomyces cerevisiae
aaccaaagac

SEQ ID NO: 3683 - DNA, 10 bp, Saccharomyces cerevisiae
aaccagtgtc

SEQ ID NO: 3684 - DNA, 10 bp, Saccharomyces cerevisiae
aaccctttta

SEQ ID NO: 3685 - DNA, 10 bp, Saccharomyces cerevisiae
aaccttaacc

SEQ ID NO: 3686 - DNA, 10 bp, Saccharomyces cerevisiae
aacgacttga

SEQ ID NO: 3687 - DNA, 10 bp, Saccharomyces cerevisiae
aacgtagtgc

SEQ ID NO: 3688 - DNA, 10 bp, Saccharomyces cerevisiae
aacgtggaag

SEQ ID NO: 3689 - DNA, 10 bp, Saccharomyces cerevisiae
aacgtttaaa

SEQ ID NO: 3690 - DNA, 10 bp, Saccharomyces cerevisiae
aactaatgga

SEQ ID NO: 3691 - DNA, 10 bp, Saccharomyces cerevisiae
aactataata

SEQ ID NO: 3692 - DNA, 10 bp, Saccharomyces cerevisiae
aactatgttt

SEQ ID NO: 3693 - DNA, 10 bp, Saccharomyces cerevisiae
aactcacaaa

SEQ ID NO: 3694 - DNA, 10 bp, Saccharomyces cerevisiae
aactcgaaaa

SEQ ID NO: 3695 - DNA, 10 bp, Saccharomyces cerevisiae
aactcgcaca

SEQ ID NO: 3696 - DNA, 10 bp, Saccharomyces cerevisiae
aactgaactg

SEQ ID NO: 3697 - DNA, 10 bp, Saccharomyces cerevisiae
aactgcaaga

SEQ ID NO: 3698 - DNA, 10 bp, Saccharomyces cerevisiae
aactgtatgc

SEQ ID NO: 3699 - DNA, 10 bp, Saccharomyces cerevisiae
aacttatttc

SEQ ID NO: 3700 - DNA, 10 bp, Saccharomyces cerevisiae
aacttcctaa

SEQ ID NO: 3701 - DNA, 10 bp, Saccharomyces cerevisiae
aactttgtat

SEQ ID NO: 3702 - DNA, 10 bp, Saccharomyces cerevisiae
aagaaagaac

SEQ ID NO: 3703 - DNA, 10 bp, Saccharomyces cerevisiae
aagaaattcc

SEQ ID NO: 3704 - DNA, 10 bp, Saccharomyces cerevisiae
aagaagaaga

SEQ ID NO: 3705 - DNA, 10 bp, Saccharomyces cerevisiae
aagacctggc

SEQ ID NO: 3706 - DNA, 10 bp, Saccharomyces cerevisiae
aagactgttg

SEQ ID NO: 3707 - DNA, 10 bp, Saccharomyces cerevisiae
aagagagtca

SEQ ID NO: 3708 - DNA, 10 bp, Saccharomyces cerevisiae
aagagccaga

SEQ ID NO: 3709 - DNA, 10 bp, Saccharomyces cerevisiae
aagaggattg

SEQ ID NO: 3710 - DNA, 10 bp, Saccharomyces cerevisiae
aagatcatcg

SEQ ID NO: 3711 - DNA, 10 bp, Saccharomyces cerevisiae
aagatgaaga

SEQ ID NO: 3712 - DNA, 10 bp, Saccharomyces cerevisiae
aagatgaagg

SEQ ID NO: 3713 - DNA, 10 bp, Saccharomyces cerevisiae
aagatgagtt

SEQ ID NO: 3714 - DNA, 10 bp, Saccharomyces cerevisiae
aagatggaat

SEQ ID NO: 3715 - DNA, 10 bp, Saccharomyces cerevisiae
aagattggac

SEQ ID NO: 3716 - DNA, 10 bp, Saccharomyces cerevisiae
aagcaaactg

SEQ ID NO: 3717 - DNA, 10 bp, Saccharomyces cerevisiae
aagccattca

SEQ ID NO: 3718 - DNA, 10 bp, Saccharomyces cerevisiae
aagccttagc

SEQ ID NO: 3719 - DNA, 10 bp, Saccharomyces cerevisiae
aagcgcacaa

SEQ ID NO: 3720 - DNA, 10 bp, Saccharomyces cerevisiae
aagctattca

SEQ ID NO: 3721 - DNA, 10 bp, Saccharomyces cerevisiae
aagcttcatc

SEQ ID NO: 3722 - DNA, 10 bp, Saccharomyces cerevisiae
aaggacttgc

SEQ ID NO: 3723 - DNA, 10 bp, Saccharomyces cerevisiae
aaggacttta

SEQ ID NO: 3724 - DNA, 10 bp, Saccharomyces cerevisiae
aaggagacac

SEQ ID NO: 3725 - DNA, 10 bp, Saccharomyces cerevisiae
aaggagagga

SEQ ID NO: 3726 - DNA, 10 bp, Saccharomyces cerevisiae
aaggattcag

SEQ ID NO: 3727 - DNA, 10 bp, Saccharomyces cerevisiae
aaggccagag

SEQ ID NO: 3728 - DNA, 10 bp, Saccharomyces cerevisiae
aaggctaatg

SEQ ID NO: 3729 - DNA, 10 bp, Saccharomyces cerevisiae
aagggttttg

SEQ ID NO: 3730 - DNA, 10 bp, Saccharomyces cerevisiae
aagtaccatt

SEQ ID NO: 3731 - DNA, 10 bp, Saccharomyces cerevisiae
aagtcattgg

SEQ ID NO: 3732 - DNA, 10 bp, Saccharomyces cerevisiae
aagtccaact

SEQ ID NO: 3733 - DNA, 10 bp, Saccharomyces cerevisiae
aagtctacat

SEQ ID NO: 3734 - DNA, 10 bp, Saccharomyces cerevisiae
aagtctcagc

SEQ ID NO: 3735 - DNA, 10 bp, Saccharomyces cerevisiae
aagtgatgaa

SEQ ID NO: 3736 - DNA, 10 bp, Saccharomyces cerevisiae
aagtggagga

SEQ ID NO: 3737 - DNA, 10 bp, Saccharomyces cerevisiae
aagtggttta

SEQ ID NO: 3738 - DNA, 10 bp, Saccharomyces cerevisiae
aagttacaat

SEQ ID NO: 3739 - DNA, 10 bp, Saccharomyces cerevisiae
aagttatagt

SEQ ID NO: 3740 - DNA, 10 bp, Saccharomyces cerevisiae
aagttctcca

SEQ ID NO: 3741 - DNA, 10 bp, Saccharomyces cerevisiae
aagttgagga

SEQ ID NO: 3742 - DNA, 10 bp, Saccharomyces cerevisiae
aagttgcaac

SEQ ID NO: 3743 - DNA, 10 bp, Saccharomyces cerevisiae
aagttggcta

SEQ ID NO: 3744 - DNA, 10 bp, Saccharomyces cerevisiae
aagtttgatc

SEQ ID NO: 3745 - DNA, 10 bp, Saccharomyces cerevisiae
aagttttttt

SEQ ID NO: 3746 - DNA, 10 bp, Saccharomyces cerevisiae
aataaagaca

SEQ ID NO: 3747 - DNA, 10 bp, Saccharomyces cerevisiae
aataccaatg

SEQ ID NO: 3748 - DNA, 10 bp, Saccharomyces cerevisiae
aatacgcata

SEQ ID NO: 3749 - DNA, 10 bp, Saccharomyces cerevisiae
aatacgttac

SEQ ID NO: 3750 - DNA, 10 bp, Saccharomyces cerevisiae
aatagaggat

SEQ ID NO: 3751 - DNA, 10 bp, Saccharomyces cerevisiae
aatagcagca

SEQ ID NO: 3752 - DNA, 10 bp, Saccharomyces cerevisiae
aatagcctca

SEQ ID NO: 3753 - DNA, 10 bp, Saccharomyces cerevisiae
aatatatata

SEQ ID NO: 3754 - DNA, 10 bp, Saccharomyces cerevisiae
aatatcaagg

SEQ ID NO: 3755 - DNA, 10 bp, Saccharomyces cerevisiae
aatatgacga

SEQ ID NO: 3756 - DNA, 10 bp, Saccharomyces cerevisiae
aatatttatt

SEQ ID NO: 3757 - DNA, 10 bp, Saccharomyces cerevisiae
aatcaataaa

SEQ ID NO: 3758 - DNA, 10 bp, Saccharomyces cerevisiae
aatccaggtg

SEQ ID NO: 3759 - DNA, 10 bp, Saccharomyces cerevisiae
aatccattcc

SEQ ID NO: 3760 - DNA, 10 bp, Saccharomyces cerevisiae
aatcccagtt

SEQ ID NO: 3761 - DNA, 10 bp, Saccharomyces cerevisiae
aatcgagaaa

SEQ ID NO: 3762 - DNA, 10 bp, Saccharomyces cerevisiae
aatctacttt

SEQ ID NO: 3763 - DNA, 10 bp, Saccharomyces cerevisiae
aatgaaacaa

SEQ ID NO: 3764 - DNA, 10 bp, Saccharomyces cerevisiae
aatgaagaac

SEQ ID NO: 3765 - DNA, 10 bp, Saccharomyces cerevisiae
aatgacttat

SEQ ID NO: 3766 - DNA, 10 bp, Saccharomyces cerevisiae
aatgggaaaa

SEQ ID NO: 3767 - DNA, 10 bp, Saccharomyces cerevisiae
aatgggtttt

SEQ ID NO: 3768 - DNA, 10 bp, Saccharomyces cerevisiae
aatgtaatat

SEQ ID NO: 3769 - DNA, 10 bp, Saccharomyces cerevisiae
aatgtacaga

SEQ ID NO: 3770 - DNA, 10 bp, Saccharomyces cerevisiae
aatgtataac

SEQ ID NO: 3771 - DNA, 10 bp, Saccharomyces cerevisiae
aatgtgcact

SEQ ID NO: 3772 - DNA, 10 bp, Saccharomyces cerevisiae
aatgtgctgt

SEQ ID NO: 3773 - DNA, 10 bp, Saccharomyces cerevisiae
aatgtggaac

SEQ ID NO: 3774 - DNA, 10 bp, Saccharomyces cerevisiae
aattaagatc

SEQ ID NO: 3775 - DNA, 10 bp, Saccharomyces cerevisiae
aattattgaa

SEQ ID NO: 3776 - DNA, 10 bp, Saccharomyces cerevisiae
aattcaggtc

SEQ ID NO: 3777 - DNA, 10 bp, Saccharomyces cerevisiae
aattcctttt

SEQ ID NO: 3778 - DNA, 10 bp, Saccharomyces cerevisiae
aattgaaaaa

SEQ ID NO: 3779 - DNA, 10 bp, Saccharomyces cerevisiae
aattgaagta

SEQ ID NO: 3780 - DNA, 10 bp, Saccharomyces cerevisiae
aattggcgaa

SEQ ID NO: 3781 - DNA, 10 bp, Saccharomyces cerevisiae
aattggttca

SEQ ID NO: 3782 - DNA, 10 bp, Saccharomyces cerevisiae
aatttaagac

SEQ ID NO: 3783 - DNA, 10 bp, Saccharomyces cerevisiae
aatttcacag

SEQ ID NO: 3784 - DNA, 10 bp, Saccharomyces cerevisiae
aatttggtgg

SEQ ID NO: 3785 - DNA, 10 bp, Saccharomyces cerevisiae
aatttttcga

SEQ ID NO: 3786 - DNA, 10 bp, Saccharomyces cerevisiae
acaaagaaag

SEQ ID NO: 3787 - DNA, 10 bp, Saccharomyces cerevisiae
acaaatgggt

SEQ ID NO: 3788 - DNA, 10 bp, Saccharomyces cerevisiae
acaagaactt

SEQ ID NO: 3789 - DNA, 10 bp, Saccharomyces cerevisiae
acaagcccaa

SEQ ID NO: 3790 - DNA, 10 bp, Saccharomyces cerevisiae
acaaggaact

SEQ ID NO: 3791 - DNA, 10 bp, Saccharomyces cerevisiae
acaatagatt

SEQ ID NO: 3792 - DNA, 10 bp, Saccharomyces cerevisiae
acaatgatga

SEQ ID NO: 3793 - DNA, 10 bp, Saccharomyces cerevisiae
acacatcata

SEQ ID NO: 3794 - DNA, 10 bp, Saccharomyces cerevisiae
acaccaccag

SEQ ID NO: 3795 - DNA, 10 bp, Saccharomyces cerevisiae
acaccagaag

SEQ ID NO: 3796 - DNA, 10 bp, Saccharomyces cerevisiae
acacccaagg

SEQ ID NO: 3797 - DNA, 10 bp, Saccharomyces cerevisiae
acacgtaaaa

SEQ ID NO: 3798 - DNA, 10 bp, Saccharomyces cerevisiae
acacgtacaa

SEQ ID NO: 3799 - DNA, 10 bp, Saccharomyces cerevisiae
acagaaaaaa

SEQ ID NO: 3800 - DNA, 10 bp, Saccharomyces cerevisiae
acagaatatc

SEQ ID NO: 3801 - DNA, 10 bp, Saccharomyces cerevisiae
acagattctt

SEQ ID NO: 3802 - DNA, 10 bp, Saccharomyces cerevisiae
acaggcaccc

SEQ ID NO: 3803 - DNA, 10 bp, Saccharomyces cerevisiae
acaggcttgc

SEQ ID NO: 3804 - DNA, 10 bp, Saccharomyces cerevisiae
acatacttgg

SEQ ID NO: 3805 - DNA, 10 bp, Saccharomyces cerevisiae
acatcactga

SEQ ID NO: 3806 - DNA, 10 bp, Saccharomyces cerevisiae
acatcattac

SEQ ID NO: 3807 - DNA, 10 bp, Saccharomyces cerevisiae
accaaaatgt

SEQ ID NO: 3808 - DNA, 10 bp, Saccharomyces cerevisiae
accaacaaga

SEQ ID NO: 3809 - DNA, 10 bp, Saccharomyces cerevisiae
accagaccag

SEQ ID NO: 3810 - DNA, 10 bp, Saccharomyces cerevisiae
accaggtcct

SEQ ID NO: 3811 - DNA, 10 bp, Saccharomyces cerevisiae
accatcgaat

SEQ ID NO: 3812 - DNA, 10 bp, Saccharomyces cerevisiae
acccaagcaa

SEQ ID NO: 3813 - DNA, 10 bp, Saccharomyces cerevisiae
accccgtaca

SEQ ID NO: 3814 - DNA, 10 bp, Saccharomyces cerevisiae
accgaatttg

SEQ ID NO: 3815 - DNA, 10 bp, Saccharomyces cerevisiae
accgcaaaga

SEQ ID NO: 3816 - DNA, 10 bp, Saccharomyces cerevisiae
accgcattag

SEQ ID NO: 3817 - DNA, 10 bp, Saccharomyces cerevisiae
accgcctagg

SEQ ID NO: 3818 - DNA, 10 bp, Saccharomyces cerevisiae
accggacgtt

SEQ ID NO: 3819 - DNA, 10 bp, Saccharomyces cerevisiae
accgttacat

SEQ ID NO: 3820 - DNA, 10 bp, Saccharomyces cerevisiae
accgttgtgc

SEQ ID NO: 3821 - DNA, 10 bp, Saccharomyces cerevisiae
acctataatt

SEQ ID NO: 3822 - DNA, 10 bp, Saccharomyces cerevisiae
acctttttag

SEQ ID NO: 3823 - DNA, 10 bp, Saccharomyces cerevisiae
acgaaataga

SEQ ID NO: 3824 - DNA, 10 bp, Saccharomyces cerevisiae
acgaacactt

SEQ ID NO: 3825 - DNA, 10 bp, Saccharomyces cerevisiae
acgaaggact

SEQ ID NO: 3826 - DNA, 10 bp, Saccharomyces cerevisiae
acgaattaaa

SEQ ID NO: 3827 - DNA, 10 bp, Saccharomyces cerevisiae
acgaattgtg

SEQ ID NO: 3828 - DNA, 10 bp, Saccharomyces cerevisiae
acgatgcaaa

SEQ ID NO: 3829 - DNA, 10 bp, Saccharomyces cerevisiae
acgattggct

SEQ ID NO: 3830 - DNA, 10 bp, Saccharomyces cerevisiae
acgcagccag

SEQ ID NO: 3831 - DNA, 10 bp, Saccharomyces cerevisiae
acgccgccaa

SEQ ID NO: 3832 - DNA, 10 bp, Saccharomyces cerevisiae
acgcctgatt

SEQ ID NO: 3833 - DNA, 10 bp, Saccharomyces cerevisiae
acgcctggat

SEQ ID NO: 3834 - DNA, 10 bp, Saccharomyces cerevisiae
acggacttct

SEQ ID NO: 3835 - DNA, 10 bp, Saccharomyces cerevisiae
acggcaaata

SEQ ID NO: 3836 - DNA, 10 bp, Saccharomyces cerevisiae
acggtcaggg

SEQ ID NO: 3837 - DNA, 10 bp, Saccharomyces cerevisiae
acgtattatg

SEQ ID NO: 3838 - DNA, 10 bp, Saccharomyces cerevisiae
acgtcattga

SEQ ID NO: 3839 - DNA, 10 bp, Saccharomyces cerevisiae
acgtcttttt

SEQ ID NO: 3840 - DNA, 10 bp, Saccharomyces cerevisiae
acgtgcagta

SEQ ID NO: 3841 - DNA, 10 bp, Saccharomyces cerevisiae
acgttatata

SEQ ID NO: 3842 - DNA, 10 bp, Saccharomyces cerevisiae
acgttcaaat

SEQ ID NO: 3843 - DNA, 10 bp, Saccharomyces cerevisiae
actaagacat

SEQ ID NO: 3844 - DNA, 10 bp, Saccharomyces cerevisiae
actaatgacg

SEQ ID NO: 3845 - DNA, 10 bp, Saccharomyces cerevisiae
actaggccac

SEQ ID NO: 3846 - DNA, 10 bp, Saccharomyces cerevisiae
actatatgtt

SEQ ID NO: 3847 - DNA, 10 bp, Saccharomyces cerevisiae
actattctgt

SEQ ID NO: 3848 - DNA, 10 bp, Saccharomyces cerevisiae
actcaaaaag

SEQ ID NO: 3849 - DNA, 10 bp, Saccharomyces cerevisiae
actccctgta

SEQ ID NO: 3850 - DNA, 10 bp, Saccharomyces cerevisiae
actcctggaa

SEQ ID NO: 3851 - DNA, 10 bp, Saccharomyces cerevisiae
actcctgttg

SEQ ID NO: 3852 - DNA, 10 bp, Saccharomyces cerevisiae
actcttactt

SEQ ID NO: 3853 - DNA, 10 bp, Saccharomyces cerevisiae
actctttctg

SEQ ID NO: 3854 - DNA, 10 bp, Saccharomyces cerevisiae
actgaaaaaa

SEQ ID NO: 3855 - DNA, 10 bp, Saccharomyces cerevisiae
actgagtgtc

SEQ ID NO: 3856 - DNA, 10 bp, Saccharomyces cerevisiae
actgcatctg

SEQ ID NO: 3857 - DNA, 10 bp, Saccharomyces cerevisiae
actgctattt

SEQ ID NO: 3858 - DNA, 10 bp, Saccharomyces cerevisiae
actgctgata

SEQ ID NO: 3859 - DNA, 10 bp, Saccharomyces cerevisiae
actgtttatg

SEQ ID NO: 3860 - DNA, 10 bp, Saccharomyces cerevisiae
acttaaaaaa

SEQ ID NO: 3861 - DNA, 10 bp, Saccharomyces cerevisiae
acttatatct

SEQ ID NO: 3862 - DNA, 10 bp, Saccharomyces cerevisiae
acttatttta

SEQ ID NO: 3863 - DNA, 10 bp, Saccharomyces cerevisiae
acttctggtc

SEQ ID NO: 3864 - DNA, 10 bp, Saccharomyces cerevisiae
acttgatata

SEQ ID NO: 3865 - DNA, 10 bp, Saccharomyces cerevisiae
acttgcttta

SEQ ID NO: 3866 - DNA, 10 bp, Saccharomyces cerevisiae
acttggtatg

SEQ ID NO: 3867 - DNA, 10 bp, Saccharomyces cerevisiae
actttctaat

SEQ ID NO: 3868 - DNA, 10 bp, Saccharomyces cerevisiae
acttttaaac

SEQ ID NO: 3869 - DNA, 10 bp, Saccharomyces cerevisiae
agaaaaaaac

SEQ ID NO: 3870 - DNA, 10 bp, Saccharomyces cerevisiae
agaaacaagt

SEQ ID NO: 3871 - DNA, 10 bp, Saccharomyces cerevisiae
agaaagctat

SEQ ID NO: 3872 - DNA, 10 bp, Saccharomyces cerevisiae
agaaagtcag

SEQ ID NO: 3873 - DNA, 10 bp, Saccharomyces cerevisiae
agaaatatgt

SEQ ID NO: 3874 - DNA, 10 bp, Saccharomyces cerevisiae
agaaatttgg

SEQ ID NO: 3875 - DNA, 10 bp, Saccharomyces cerevisiae
agaacataac

SEQ ID NO: 3876 - DNA, 10 bp, Saccharomyces cerevisiae
agaagaacca

SEQ ID NO: 3877 - DNA, 10 bp, Saccharomyces cerevisiae
agaagggcta

SEQ ID NO: 3878 - DNA, 10 bp, Saccharomyces cerevisiae
agaattgatt

SEQ ID NO: 3879 - DNA, 10 bp, Saccharomyces cerevisiae
agacaaaccg

SEQ ID NO: 3880 - DNA, 10 bp, Saccharomyces cerevisiae
agacaaactc

SEQ ID NO: 3881 - DNA, 10 bp, Saccharomyces cerevisiae
agacaactga

SEQ ID NO: 3882 - DNA, 10 bp, Saccharomyces cerevisiae
agacaggcca

SEQ ID NO: 3883 - DNA, 10 bp, Saccharomyces cerevisiae
agaccagtgc

SEQ ID NO: 3884 - DNA, 10 bp, Saccharomyces cerevisiae
agacctgccc

SEQ ID NO: 3885 - DNA, 10 bp, Saccharomyces cerevisiae
agagagcaag

SEQ ID NO: 3886 - DNA, 10 bp, Saccharomyces cerevisiae
agagaggtat

SEQ ID NO: 3887 - DNA, 10 bp, Saccharomyces cerevisiae
agagcagctg

SEQ ID NO: 3888 - DNA, 10 bp, Saccharomyces cerevisiae
agagcgaatt

SEQ ID NO: 3889 - DNA, 10 bp, Saccharomyces cerevisiae
agagggatga

SEQ ID NO: 3890 - DNA, 10 bp, Saccharomyces cerevisiae
agagtatttt

SEQ ID NO: 3891 - DNA, 10 bp, Saccharomyces cerevisiae
agagttttac

SEQ ID NO: 3892 - DNA, 10 bp, Saccharomyces cerevisiae
agatactgac

SEQ ID NO: 3893 - DNA, 10 bp, Saccharomyces cerevisiae
agatatggat

SEQ ID NO: 3894 - DNA, 10 bp, Saccharomyces cerevisiae
agatcgagga

SEQ ID NO: 3895 - DNA, 10 bp, Saccharomyces cerevisiae
agattgtgcc

SEQ ID NO: 3896 - DNA, 10 bp, Saccharomyces cerevisiae
agcaagaaga

SEQ ID NO: 3897 - DNA, 10 bp, Saccharomyces cerevisiae
agcaattttt

SEQ ID NO: 3898 - DNA, 10 bp, Saccharomyces cerevisiae
agcacacgct

SEQ ID NO: 3899 - DNA, 10 bp, Saccharomyces cerevisiae
agcacctatg

SEQ ID NO: 3900 - DNA, 10 bp, Saccharomyces cerevisiae
agcactccct

SEQ ID NO: 3901 - DNA, 10 bp, Saccharomyces cerevisiae
agcatatcaa

SEQ ID NO: 3902 - DNA, 10 bp, Saccharomyces cerevisiae
agccataatt

SEQ ID NO: 3903 - DNA, 10 bp, Saccharomyces cerevisiae
agcccacggc

SEQ ID NO: 3904 - DNA, 10 bp, Saccharomyces cerevisiae
agcccgtttt

SEQ ID NO: 3905 - DNA, 10 bp, Saccharomyces cerevisiae
agcgaatgta

SEQ ID NO: 3906 - DNA, 10 bp, Saccharomyces cerevisiae
agcgtttgat

SEQ ID NO: 3907 - DNA, 10 bp, Saccharomyces cerevisiae
agctatcttt

SEQ ID NO: 3908 - DNA, 10 bp, Saccharomyces cerevisiae
agctattata

SEQ ID NO: 3909 - DNA, 10 bp, Saccharomyces cerevisiae
aggaaaaaga

SEQ ID NO: 3910 - DNA, 10 bp, Saccharomyces cerevisiae
aggaagcaag

SEQ ID NO: 3911 - DNA, 10 bp, Saccharomyces cerevisiae
aggacactca

SEQ ID NO: 3912 - DNA, 10 bp, Saccharomyces cerevisiae
aggagaacac

SEQ ID NO: 3913 - DNA, 10 bp, Saccharomyces cerevisiae
aggagggtat

SEQ ID NO: 3914 - DNA, 10 bp, Saccharomyces cerevisiae
aggatccgaa

SEQ ID NO: 3915 - DNA, 10 bp, Saccharomyces cerevisiae
aggcaagaga

SEQ ID NO: 3916 - DNA, 10 bp, Saccharomyces cerevisiae
aggcagcgct

SEQ ID NO: 3917 - DNA, 10 bp, Saccharomyces cerevisiae
aggccgtttt

SEQ ID NO: 3918 - DNA, 10 bp, Saccharomyces cerevisiae
aggctgcagt

SEQ ID NO: 3919 - DNA, 10 bp, Saccharomyces cerevisiae
agggtcattc

SEQ ID NO: 3920 - DNA, 10 bp, Saccharomyces cerevisiae
agggttcttg

SEQ ID NO: 3921 - DNA, 10 bp, Saccharomyces cerevisiae
aggtagggtg

SEQ ID NO: 3922 - DNA, 10 bp, Saccharomyces cerevisiae
aggtatgcac

SEQ ID NO: 3923 - DNA, 10 bp, Saccharomyces cerevisiae
aggtctatgg

SEQ ID NO: 3924 - DNA, 10 bp, Saccharomyces cerevisiae
aggtgcaaaa

SEQ ID NO: 3925 - DNA, 10 bp, Saccharomyces cerevisiae
aggtgcatca

SEQ ID NO: 3926 - DNA, 10 bp, Saccharomyces cerevisiae
aggtggttaa

SEQ ID NO: 3927 - DNA, 10 bp, Saccharomyces cerevisiae
aggttcaaaa

SEQ ID NO: 3928 - DNA, 10 bp, Saccharomyces cerevisiae
aggttgacat

SEQ ID NO: 3929 - DNA, 10 bp, Saccharomyces cerevisiae
agtatagcta

SEQ ID NO: 3930 - DNA, 10 bp, Saccharomyces cerevisiae
agtgacgatg

SEQ ID NO: 3931 - DNA, 10 bp, Saccharomyces cerevisiae
agtgacttac

SEQ ID NO: 3932 - DNA, 10 bp, Saccharomyces cerevisiae
agtgattgtt

SEQ ID NO: 3933 - DNA, 10 bp, Saccharomyces cerevisiae
agtgccaatg

SEQ ID NO: 3934 - DNA, 10 bp, Saccharomyces cerevisiae
agtggaaaag

SEQ ID NO: 3935 - DNA, 10 bp, Saccharomyces cerevisiae
agtgtgtcta

SEQ ID NO: 3936 - DNA, 10 bp, Saccharomyces cerevisiae
agtgttaacg

SEQ ID NO: 3937 - DNA, 10 bp, Saccharomyces cerevisiae
agttattccc

SEQ ID NO: 3938 - DNA, 10 bp, Saccharomyces cerevisiae
agttgtatcc

SEQ ID NO: 3939 - DNA, 10 bp, Saccharomyces cerevisiae
agtttcaaaa

SEQ ID NO: 3940 - DNA, 10 bp, Saccharomyces cerevisiae
agtttcggtt

SEQ ID NO: 3941 - DNA, 10 bp, Saccharomyces cerevisiae
agttttcctg

SEQ ID NO: 3942 - DNA, 10 bp, Saccharomyces cerevisiae
ataaaatctt

SEQ ID NO: 3943 - DNA, 10 bp, Saccharomyces cerevisiae
ataaaccact

SEQ ID NO: 3944 - DNA, 10 bp, Saccharomyces cerevisiae
ataaacctga

SEQ ID NO: 3945 - DNA, 10 bp, Saccharomyces cerevisiae
ataacacctc

SEQ ID NO: 3946 - DNA, 10 bp, Saccharomyces cerevisiae
ataacttcgg

SEQ ID NO: 3947 - DNA, 10 bp, Saccharomyces cerevisiae
ataagacggc

SEQ ID NO: 3948 - DNA, 10 bp, Saccharomyces cerevisiae
ataagtaaaa

SEQ ID NO: 3949 - DNA, 10 bp, Saccharomyces cerevisiae
ataagtgtgc

SEQ ID NO: 3950 - DNA, 10 bp, Saccharomyces cerevisiae
ataataatgg

SEQ ID NO: 3951 - DNA, 10 bp, Saccharomyces cerevisiae
ataatgatac

SEQ ID NO: 3952 - DNA, 10 bp, Saccharomyces cerevisiae
ataattggag

SEQ ID NO: 3953 - DNA, 10 bp, Saccharomyces cerevisiae
ataatttttt

SEQ ID NO: 3954 - DNA, 10 bp, Saccharomyces cerevisiae
atacagattc

SEQ ID NO: 3955 - DNA, 10 bp, Saccharomyces cerevisiae
atacatcgca

SEQ ID NO: 3956 - DNA, 10 bp, Saccharomyces cerevisiae
ataccaagtt

SEQ ID NO: 3957 - DNA, 10 bp, Saccharomyces cerevisiae
atacccaatt

SEQ ID NO: 3958 - DNA, 10 bp, Saccharomyces cerevisiae
atacgtgtac

SEQ ID NO: 3959 - DNA, 10 bp, Saccharomyces cerevisiae
atacttgaat

SEQ ID NO: 3960 - DNA, 10 bp, Saccharomyces cerevisiae
atagcaaagg

SEQ ID NO: 3961 - DNA, 10 bp, Saccharomyces cerevisiae
atagtacaga

SEQ ID NO: 3962 - DNA, 10 bp, Saccharomyces cerevisiae
atagtagatg

SEQ ID NO: 3963 - DNA, 10 bp, Saccharomyces cerevisiae
atataaaaaa

SEQ ID NO: 3964 - DNA, 10 bp, Saccharomyces cerevisiae
atatagacgc

SEQ ID NO: 3965 - DNA, 10 bp, Saccharomyces cerevisiae
atatataatc

SEQ ID NO: 3966 - DNA, 10 bp, Saccharomyces cerevisiae
atatatttga

SEQ ID NO: 3967 - DNA, 10 bp, Saccharomyces cerevisiae
atatccctac

SEQ ID NO: 3968 - DNA, 10 bp, Saccharomyces cerevisiae
atatgacgtc

SEQ ID NO: 3969 - DNA, 10 bp, Saccharomyces cerevisiae
atattgaatc

SEQ ID NO: 3970 - DNA, 10 bp, Saccharomyces cerevisiae
atcaacgggg

SEQ ID NO: 3971 - DNA, 10 bp, Saccharomyces cerevisiae
atcacagtat

SEQ ID NO: 3972 - DNA, 10 bp, Saccharomyces cerevisiae
atcacctatt

SEQ ID NO: 3973 - DNA, 10 bp, Saccharomyces cerevisiae
atcactgggt

SEQ ID NO: 3974 - DNA, 10 bp, Saccharomyces cerevisiae
atcactggtt

SEQ ID NO: 3975 - DNA, 10 bp, Saccharomyces cerevisiae
atcagaatgc

SEQ ID NO: 3976 - DNA, 10 bp, Saccharomyces cerevisiae
atcataatca

SEQ ID NO: 3977 - DNA, 10 bp, Saccharomyces cerevisiae
atcattgcaa

SEQ ID NO: 3978 - DNA, 10 bp, Saccharomyces cerevisiae
atcattttat

SEQ ID NO: 3979 - DNA, 10 bp, Saccharomyces cerevisiae
atccagttga

SEQ ID NO: 3980 - DNA, 10 bp, Saccharomyces cerevisiae
atccgccaga

SEQ ID NO: 3981 - DNA, 10 bp, Saccharomyces cerevisiae
atccttcagg

SEQ ID NO: 3982 - DNA, 10 bp, Saccharomyces cerevisiae
atcgcgattg

SEQ ID NO: 3983 - DNA, 10 bp, Saccharomyces cerevisiae
atcgcggctc

SEQ ID NO: 3984 - DNA, 10 bp, Saccharomyces cerevisiae
atcggtggtc

SEQ ID NO: 3985 - DNA, 10 bp, Saccharomyces cerevisiae
atctaataat

SEQ ID NO: 3986 - DNA, 10 bp, Saccharomyces cerevisiae
atctcttgag

SEQ ID NO: 3987 - DNA, 10 bp, Saccharomyces cerevisiae
atctgtatgt

SEQ ID NO: 3988 - DNA, 10 bp, Saccharomyces cerevisiae
atctttaatc

SEQ ID NO: 3989 - DNA, 10 bp, Saccharomyces cerevisiae
atctttatca

SEQ ID NO: 3990 - DNA, 10 bp, Saccharomyces cerevisiae
atctttcacc

SEQ ID NO: 3991 - DNA, 10 bp, Saccharomyces cerevisiae
atgaacttat

SEQ ID NO: 3992 - DNA, 10 bp, Saccharomyces cerevisiae
atgaactttg

SEQ ID NO: 3993 - DNA, 10 bp, Saccharomyces cerevisiae
atgaagacgt

SEQ ID NO: 3994 - DNA, 10 bp, Saccharomyces cerevisiae
atgaaggttg

SEQ ID NO: 3995 - DNA, 10 bp, Saccharomyces cerevisiae
atgaccccaa

SEQ ID NO: 3996 - DNA, 10 bp, Saccharomyces cerevisiae
atgacgatga

SEQ ID NO: 3997 - DNA, 10 bp, Saccharomyces cerevisiae
atgacgctaa

SEQ ID NO: 3998 - DNA, 10 bp, Saccharomyces cerevisiae
atgacgtgga

SEQ ID NO: 3999 - DNA, 10 bp, Saccharomyces cerevisiae
atgagcattt

SEQ ID NO: 4000 - DNA, 10 bp, Saccharomyces cerevisiae
atgagcttta

SEQ ID NO: 4001 - DNA, 10 bp, Saccharomyces cerevisiae
atgaggcgct

SEQ ID NO: 4002 - DNA, 10 bp, Saccharomyces cerevisiae
atgagttatt

SEQ ID NO: 4003 - DNA, 10 bp, Saccharomyces cerevisiae
atgagtttgg

SEQ ID NO: 4004 - DNA, 10 bp, Saccharomyces cerevisiae
atgatggcac

SEQ ID NO: 4005 - DNA, 10 bp, Saccharomyces cerevisiae
atgatgtgat

SEQ ID NO: 4006 - DNA, 10 bp, Saccharomyces cerevisiae
atgatttgta

SEQ ID NO: 4007 - DNA, 10 bp, Saccharomyces cerevisiae
atgcaaaaaa

SEQ ID NO: 4008 - DNA, 10 bp, Saccharomyces cerevisiae
atgcaaagaa

SEQ ID NO: 4009 - DNA, 10 bp, Saccharomyces cerevisiae
atgcagagta

SEQ ID NO: 4010 - DNA, 10 bp, Saccharomyces cerevisiae
atgcattatg

SEQ ID NO: 4011 - DNA, 10 bp, Saccharomyces cerevisiae
atgctatgtc

SEQ ID NO: 4012 - DNA, 10 bp, Saccharomyces cerevisiae
atgctggagt

SEQ ID NO: 4013 - DNA, 10 bp, Saccharomyces cerevisiae
atgctgttaa

SEQ ID NO: 4014 - DNA, 10 bp, Saccharomyces cerevisiae
atggaacttg

SEQ ID NO: 4015 - DNA, 10 bp, Saccharomyces cerevisiae
atggagcatc

SEQ ID NO: 4016 - DNA, 10 bp, Saccharomyces cerevisiae
atggaggttc

SEQ ID NO: 4017 - DNA, 10 bp, Saccharomyces cerevisiae
atggctcagt

SEQ ID NO: 4018 - DNA, 10 bp, Saccharomyces cerevisiae
atgggataaa

SEQ ID NO: 4019 - DNA, 10 bp, Saccharomyces cerevisiae
atggttttaa

SEQ ID NO: 4020 - DNA, 10 bp, Saccharomyces cerevisiae
atgtagatgg

SEQ ID NO: 4021 - DNA, 10 bp, Saccharomyces cerevisiae
atgtcaagtg

SEQ ID NO: 4022 - DNA, 10 bp, Saccharomyces cerevisiae
atgtcagtga

SEQ ID NO: 4023 - DNA, 10 bp, Saccharomyces cerevisiae
attaaataaa

SEQ ID NO: 4024 - DNA, 10 bp, Saccharomyces cerevisiae
attaatatga

SEQ ID NO: 4025 - DNA, 10 bp, Saccharomyces cerevisiae
attaatgacc

SEQ ID NO: 4026 - DNA, 10 bp, Saccharomyces cerevisiae
attactgcca

SEQ ID NO: 4027 - DNA, 10 bp, Saccharomyces cerevisiae
attattcttg

SEQ ID NO: 4028 - DNA, 10 bp, Saccharomyces cerevisiae
attcacgtat

SEQ ID NO: 4029 - DNA, 10 bp, Saccharomyces cerevisiae
attcccgtgg

SEQ ID NO: 4030 - DNA, 10 bp, Saccharomyces cerevisiae
attccttgca

SEQ ID NO: 4031 - DNA, 10 bp, Saccharomyces cerevisiae
attcgtaaag

SEQ ID NO: 4032 - DNA, 10 bp, Saccharomyces cerevisiae
attctggatc

SEQ ID NO: 4033 - DNA, 10 bp, Saccharomyces cerevisiae
attgaaaaaa

SEQ ID NO: 4034 - DNA, 10 bp, Saccharomyces cerevisiae
attgagcaaa

SEQ ID NO: 4035 - DNA, 10 bp, Saccharomyces cerevisiae
attgatgcgg

SEQ ID NO: 4036 - DNA, 10 bp, Saccharomyces cerevisiae
attgcgccct

SEQ ID NO: 4037 - DNA, 10 bp, Saccharomyces cerevisiae
attgcgctta

SEQ ID NO: 4038 - DNA, 10 bp, Saccharomyces cerevisiae
attgcggtct

SEQ ID NO: 4039 - DNA, 10 bp, Saccharomyces cerevisiae
attgctactt

SEQ ID NO: 4040 - DNA, 10 bp, Saccharomyces cerevisiae
attgctttac

SEQ ID NO: 4041 - DNA, 10 bp, Saccharomyces cerevisiae
attgtaaaaa

SEQ ID NO: 4042 - DNA, 10 bp, Saccharomyces cerevisiae
attgtagtaa

SEQ ID NO: 4043 - DNA, 10 bp, Saccharomyces cerevisiae
attgtgattg

SEQ ID NO: 4044 - DNA, 10 bp, Saccharomyces cerevisiae
attgtttaac

SEQ ID NO: 4045 - DNA, 10 bp, Saccharomyces cerevisiae
attgtttgca

SEQ ID NO: 4046 - DNA, 10 bp, Saccharomyces cerevisiae
atttaaaaca

SEQ ID NO: 4047 - DNA, 10 bp, Saccharomyces cerevisiae
atttaatacc

SEQ ID NO: 4048 - DNA, 10 bp, Saccharomyces cerevisiae
atttccctaa

SEQ ID NO: 4049 - DNA, 10 bp, Saccharomyces cerevisiae
atttggaaac

SEQ ID NO: 4050 - DNA, 10 bp, Saccharomyces cerevisiae
atttgtatat

SEQ ID NO: 4051 - DNA, 10 bp, Saccharomyces cerevisiae
attttatata

SEQ ID NO: 4052 - DNA, 10 bp, Saccharomyces cerevisiae
attttgaaaa

SEQ ID NO: 4053 - DNA, 10 bp, Saccharomyces cerevisiae
atttttgcta

SEQ ID NO: 4054 - DNA, 10 bp, Saccharomyces cerevisiae
atttttttct

SEQ ID NO: 4055 - DNA, 10 bp, Saccharomyces cerevisiae
attttttttt

SEQ ID NO: 4056 - DNA, 10 bp, Saccharomyces cerevisiae
caaaaagtcg

SEQ ID NO: 4057 - DNA, 10 bp, Saccharomyces cerevisiae
caaaacccta

SEQ ID NO: 4058 - DNA, 10 bp, Saccharomyces cerevisiae
caaacttttc

SEQ ID NO: 4059 - DNA, 10 bp, Saccharomyces cerevisiae
caaataagtg

SEQ ID NO: 4060 - DNA, 10 bp, Saccharomyces cerevisiae
caaatgagaa

SEQ ID NO: 4061 - DNA, 10 bp, Saccharomyces cerevisiae
caaatgcatt

SEQ ID NO: 4062 - DNA, 10 bp, Saccharomyces cerevisiae
caaattgtgt

SEQ ID NO: 4063 - DNA, 10 bp, Saccharomyces cerevisiae
caacaatggc

SEQ ID NO: 4064 - DNA, 10 bp, Saccharomyces cerevisiae
caaccagtta

SEQ ID NO: 4065 - DNA, 10 bp, Saccharomyces cerevisiae
caactagcaa

SEQ ID NO: 4066 - DNA, 10 bp, Saccharomyces cerevisiae
caagaagaaa

SEQ ID NO: 4067 - DNA, 10 bp, Saccharomyces cerevisiae
caagaagggc

SEQ ID NO: 4068 - DNA, 10 bp, Saccharomyces cerevisiae
caagaccagt

SEQ ID NO: 4069 - DNA, 10 bp, Saccharomyces cerevisiae
caagatgaaa

SEQ ID NO: 4070 - DNA, 10 bp, Saccharomyces cerevisiae
caagcgtgca

SEQ ID NO: 4071 - DNA, 10 bp, Saccharomyces cerevisiae
caagctttct

SEQ ID NO: 4072 - DNA, 10 bp, Saccharomyces cerevisiae
caagtagata

SEQ ID NO: 4073 - DNA, 10 bp, Saccharomyces cerevisiae
caagttaaaa

SEQ ID NO: 4074 - DNA, 10 bp, Saccharomyces cerevisiae
caagttagga

SEQ ID NO: 4075 - DNA, 10 bp, Saccharomyces cerevisiae
caatattcaa

SEQ ID NO: 4076 - DNA, 10 bp, Saccharomyces cerevisiae
caatgaatga

SEQ ID NO: 4077 - DNA, 10 bp, Saccharomyces cerevisiae
caatgtatat

SEQ ID NO: 4078 - DNA, 10 bp, Saccharomyces cerevisiae
caattattaa

SEQ ID NO: 4079 - DNA, 10 bp, Saccharomyces cerevisiae
caattggcaa

SEQ ID NO: 4080 - DNA, 10 bp, Saccharomyces cerevisiae
cacaaaagga

SEQ ID NO: 4081 - DNA, 10 bp, Saccharomyces cerevisiae
cacaactaca

SEQ ID NO: 4082 - DNA, 10 bp, Saccharomyces cerevisiae
cacaccaagc

SEQ ID NO: 4083 - DNA, 10 bp, Saccharomyces cerevisiae
cacaccagga

SEQ ID NO: 4084 - DNA, 10 bp, Saccharomyces cerevisiae
cacacgctca

SEQ ID NO: 4085 - DNA, 10 bp, Saccharomyces cerevisiae
cacagtacct

SEQ ID NO: 4086 - DNA, 10 bp, Saccharomyces cerevisiae
cacataatct

SEQ ID NO: 4087 - DNA, 10 bp, Saccharomyces cerevisiae
cacatcctca

SEQ ID NO: 4088 - DNA, 10 bp, Saccharomyces cerevisiae
caccagtgta

SEQ ID NO: 4089 - DNA, 10 bp, Saccharomyces cerevisiae
cacctatgaa

SEQ ID NO: 4090 - DNA, 10 bp, Saccharomyces cerevisiae
cacgatcgac

SEQ ID NO: 4091 - DNA, 10 bp, Saccharomyces cerevisiae
cactacccag

SEQ ID NO: 4092 - DNA, 10 bp, Saccharomyces cerevisiae
cactattagc

SEQ ID NO: 4093 - DNA, 10 bp, Saccharomyces cerevisiae
cactgtctcc

SEQ ID NO: 4094 - DNA, 10 bp, Saccharomyces cerevisiae
cactttataa

SEQ ID NO: 4095 - DNA, 10 bp, Saccharomyces cerevisiae
cagaatttca

SEQ ID NO: 4096 - DNA, 10 bp, Saccharomyces cerevisiae
cagacttggc

SEQ ID NO: 4097 - DNA, 10 bp, Saccharomyces cerevisiae
cagagacgct

SEQ ID NO: 4098 - DNA, 10 bp, Saccharomyces cerevisiae
cagatgataa

SEQ ID NO: 4099 - DNA, 10 bp, Saccharomyces cerevisiae
cagcaactac

SEQ ID NO: 4100 - DNA, 10 bp, Saccharomyces cerevisiae
cagctactca

SEQ ID NO: 4101 - DNA, 10 bp, Saccharomyces cerevisiae
cagcttatgg

SEQ ID NO: 4102 - DNA, 10 bp, Saccharomyces cerevisiae
caggataaac

SEQ ID NO: 4103 - DNA, 10 bp, Saccharomyces cerevisiae
caggtttagc

SEQ ID NO: 4104 - DNA, 10 bp, Saccharomyces cerevisiae
cagtacaaac

SEQ ID NO: 4105 - DNA, 10 bp, Saccharomyces cerevisiae
cataaaaaaa

SEQ ID NO: 4106 - DNA, 10 bp, Saccharomyces cerevisiae
catacagcaa

SEQ ID NO: 4107 - DNA, 10 bp, Saccharomyces cerevisiae
catactctat

SEQ ID NO: 4108 - DNA, 10 bp, Saccharomyces cerevisiae
catagaaaaa

SEQ ID NO: 4109 - DNA, 10 bp, Saccharomyces cerevisiae
catagaaagt

SEQ ID NO: 4110 - DNA, 10 bp, Saccharomyces cerevisiae
catagaagtg

SEQ ID NO: 4111 - DNA, 10 bp, Saccharomyces cerevisiae
catagatcaa

SEQ ID NO: 4112 - DNA, 10 bp, Saccharomyces cerevisiae
cataggcggt

SEQ ID NO: 4113 - DNA, 10 bp, Saccharomyces cerevisiae
cataggtgaa

SEQ ID NO: 4114 - DNA, 10 bp, Saccharomyces cerevisiae
catagtgtat

SEQ ID NO: 4115 - DNA, 10 bp, Saccharomyces cerevisiae
catcaaggcg

SEQ ID NO: 4116 - DNA, 10 bp, Saccharomyces cerevisiae
catcaccaat

SEQ ID NO: 4117 - DNA, 10 bp, Saccharomyces cerevisiae
catcaccatc

SEQ ID NO: 4118 - DNA, 10 bp, Saccharomyces cerevisiae
catcctctcg

SEQ ID NO: 4119 - DNA, 10 bp, Saccharomyces cerevisiae
cattaatata

SEQ ID NO: 4120 - DNA, 10 bp, Saccharomyces cerevisiae
cattcaaagg

SEQ ID NO: 4121 - DNA, 10 bp, Saccharomyces cerevisiae
cattctgaat

SEQ ID NO: 4122 - DNA, 10 bp, Saccharomyces cerevisiae
cattttacac

SEQ ID NO: 4123 - DNA, 10 bp, Saccharomyces cerevisiae
ccaaaacttt

SEQ ID NO: 4124 - DNA, 10 bp, Saccharomyces cerevisiae
ccaacagggt

SEQ ID NO: 4125 - DNA, 10 bp, Saccharomyces cerevisiae
ccaacgaaaa

SEQ ID NO: 4126 - DNA, 10 bp, Saccharomyces cerevisiae
ccaacgtttt

SEQ ID NO: 4127 - DNA, 10 bp, Saccharomyces cerevisiae
ccaagggtgt

SEQ ID NO: 4128 - DNA, 10 bp, Saccharomyces cerevisiae
ccaagggttc

SEQ ID NO: 4129 - DNA, 10 bp, Saccharomyces cerevisiae
ccaagtctcg

SEQ ID NO: 4130 - DNA, 10 bp, Saccharomyces cerevisiae
ccacatttca

SEQ ID NO: 4131 - DNA, 10 bp, Saccharomyces cerevisiae
ccacgggtct

SEQ ID NO: 4132 - DNA, 10 bp, Saccharomyces cerevisiae
ccagaagaaa

SEQ ID NO: 4133 - DNA, 10 bp, Saccharomyces cerevisiae
ccagaataga

SEQ ID NO: 4134 - DNA, 10 bp, Saccharomyces cerevisiae
ccagacagtg

SEQ ID NO: 4135 - DNA, 10 bp, Saccharomyces cerevisiae
ccagatatgc

SEQ ID NO: 4136 - DNA, 10 bp, Saccharomyces cerevisiae
ccagcgcgta

SEQ ID NO: 4137 - DNA, 10 bp, Saccharomyces cerevisiae
ccaggtaatt

SEQ ID NO: 4138 - DNA, 10 bp, Saccharomyces cerevisiae
ccataaaagc

SEQ ID NO: 4139 - DNA, 10 bp, Saccharomyces cerevisiae
ccatatagac

SEQ ID NO: 4140 - DNA, 10 bp, Saccharomyces cerevisiae
ccatctttta

SEQ ID NO: 4141 - DNA, 10 bp, Saccharomyces cerevisiae
ccattaaata

SEQ ID NO: 4142 - DNA, 10 bp, Saccharomyces cerevisiae
ccattagaat

SEQ ID NO: 4143 - DNA, 10 bp, Saccharomyces cerevisiae
ccattccaac

SEQ ID NO: 4144 - DNA, 10 bp, Saccharomyces cerevisiae
ccattgttcc

SEQ ID NO: 4145 - DNA, 10 bp, Saccharomyces cerevisiae
ccattttgtt

SEQ ID NO: 4146 - DNA, 10 bp, Saccharomyces cerevisiae
cccagatttg

SEQ ID NO: 4147 - DNA, 10 bp, Saccharomyces cerevisiae
cccatagtgg

SEQ ID NO: 4148 - DNA, 10 bp, Saccharomyces cerevisiae
ccccaagtgg

SEQ ID NO: 4149 - DNA, 10 bp, Saccharomyces cerevisiae
cccggatgtt

SEQ ID NO: 4150 - DNA, 10 bp, Saccharomyces cerevisiae
ccctagcgcg

SEQ ID NO: 4151 - DNA, 10 bp, Saccharomyces cerevisiae
ccgaataagg

SEQ ID NO: 4152 - DNA, 10 bp, Saccharomyces cerevisiae
ccgacggcag

SEQ ID NO: 4153 - DNA, 10 bp, Saccharomyces cerevisiae
ccgatgatgg

SEQ ID NO: 4154 - DNA, 10 bp, Saccharomyces cerevisiae
ccgccttccc

SEQ ID NO: 4155 - DNA, 10 bp, Saccharomyces cerevisiae
ccgcgctgcg

SEQ ID NO: 4156 - DNA, 10 bp, Saccharomyces cerevisiae
ccggaagagc

SEQ ID NO: 4157 - DNA, 10 bp, Saccharomyces cerevisiae
ccgtgcgtgc

SEQ ID NO: 4158 - DNA, 10 bp, Saccharomyces cerevisiae
ccgtttcttt

SEQ ID NO: 4159 - DNA, 10 bp, Saccharomyces cerevisiae
cctaaaaaaa

SEQ ID NO: 4160 - DNA, 10 bp, Saccharomyces cerevisiae
cctaagcagt

SEQ ID NO: 4161 - DNA, 10 bp, Saccharomyces cerevisiae
cctacttggc

SEQ ID NO: 4162 - DNA, 10 bp, Saccharomyces cerevisiae
cctattaagc

SEQ ID NO: 4163 - DNA, 10 bp, Saccharomyces cerevisiae
cctcatcaag

SEQ ID NO: 4164 - DNA, 10 bp, Saccharomyces cerevisiae
cctccaaagc

SEQ ID NO: 4165 - DNA, 10 bp, Saccharomyces cerevisiae
cctccagaag

SEQ ID NO: 4166 - DNA, 10 bp, Saccharomyces cerevisiae
cctctggata

SEQ ID NO: 4167 - DNA, 10 bp, Saccharomyces cerevisiae
cctcttaaaa

SEQ ID NO: 4168 - DNA, 10 bp, Saccharomyces cerevisiae
cctgtatttt

SEQ ID NO: 4169 - DNA, 10 bp, Saccharomyces cerevisiae
cctgttcgag

SEQ ID NO: 4170 - DNA, 10 bp, Saccharomyces cerevisiae
ccttgagaat

SEQ ID NO: 4171 - DNA, 10 bp, Saccharomyces cerevisiae
ccttgtggga

SEQ ID NO: 4172 - DNA, 10 bp, Saccharomyces cerevisiae
ccttttctat

SEQ ID NO: 4173 - DNA, 10 bp, Saccharomyces cerevisiae
cctttttcta

SEQ ID NO: 4174 - DNA, 10 bp, Saccharomyces cerevisiae
cgaaaaggaa

SEQ ID NO: 4175 - DNA, 10 bp, Saccharomyces cerevisiae
cgaaacccaa

SEQ ID NO: 4176 - DNA, 10 bp, Saccharomyces cerevisiae
cgaaagcttt

SEQ ID NO: 4177 - DNA, 10 bp, Saccharomyces cerevisiae
cgaaggtaag

SEQ ID NO: 4178 - DNA, 10 bp, Saccharomyces cerevisiae
cgacctcact

SEQ ID NO: 4179 - DNA, 10 bp, Saccharomyces cerevisiae
cgactattgt

SEQ ID NO: 4180 - DNA, 10 bp, Saccharomyces cerevisiae
cgaggaatat

SEQ ID NO: 4181 - DNA, 10 bp, Saccharomyces cerevisiae
cgagtattct

SEQ ID NO: 4182 - DNA, 10 bp, Saccharomyces cerevisiae
cgattgaata

SEQ ID NO: 4183 - DNA, 10 bp, Saccharomyces cerevisiae
cgattgcaaa

SEQ ID NO: 4184 - DNA, 10 bp, Saccharomyces cerevisiae
cgatttggtg

SEQ ID NO: 4185 - DNA, 10 bp, Saccharomyces cerevisiae
cgattttcag

SEQ ID NO: 4186 - DNA, 10 bp, Saccharomyces cerevisiae
cgcaccctgc

SEQ ID NO: 4187 - DNA, 10 bp, Saccharomyces cerevisiae
cgcaggtgac

SEQ ID NO: 4188 - DNA, 10 bp, Saccharomyces cerevisiae
cgcaggttac

SEQ ID NO: 4189 - DNA, 10 bp, Saccharomyces cerevisiae
cgcccctgag

SEQ ID NO: 4190 - DNA, 10 bp, Saccharomyces cerevisiae
cgcctatggt

SEQ ID NO: 4191 - DNA, 10 bp, Saccharomyces cerevisiae
cgcgaaactt

SEQ ID NO: 4192 - DNA, 10 bp, Saccharomyces cerevisiae
cgctaaataa

SEQ ID NO: 4193 - DNA, 10 bp, Saccharomyces cerevisiae
cgctacgttt

SEQ ID NO: 4194 - DNA, 10 bp, Saccharomyces cerevisiae
cgctcagtta

SEQ ID NO: 4195 - DNA, 10 bp, Saccharomyces cerevisiae
cgcttctcac

SEQ ID NO: 4196 - DNA, 10 bp, Saccharomyces cerevisiae
cggacacttt

SEQ ID NO: 4197 - DNA, 10 bp, Saccharomyces cerevisiae
cggccatccg

SEQ ID NO: 4198 - DNA, 10 bp, Saccharomyces cerevisiae
cggcccacaa

SEQ ID NO: 4199 - DNA, 10 bp, Saccharomyces cerevisiae
cgggatcaag

SEQ ID NO: 4200 - DNA, 10 bp, Saccharomyces cerevisiae
cgggtatttg

SEQ ID NO: 4201 - DNA, 10 bp, Saccharomyces cerevisiae
cggtaaagtt

SEQ ID NO: 4202 - DNA, 10 bp, Saccharomyces cerevisiae
cggtctctct

SEQ ID NO: 4203 - DNA, 10 bp, Saccharomyces cerevisiae
cggtggacag

SEQ ID NO: 4204 - DNA, 10 bp, Saccharomyces cerevisiae
cggtgttaac

SEQ ID NO: 4205 - DNA, 10 bp, Saccharomyces cerevisiae
cgtcactgtg

SEQ ID NO: 4206 - DNA, 10 bp, Saccharomyces cerevisiae
cgtcagctgt

SEQ ID NO: 4207 - DNA, 10 bp, Saccharomyces cerevisiae
cgtcgtggtg

SEQ ID NO: 4208 - DNA, 10 bp, Saccharomyces cerevisiae
cgtgaactca

SEQ ID NO: 4209 - DNA, 10 bp, Saccharomyces cerevisiae
cgtgcagtgc

SEQ ID NO: 4210 - DNA, 10 bp, Saccharomyces cerevisiae
cgtggtttca

SEQ ID NO: 4211 - DNA, 10 bp, Saccharomyces cerevisiae
cgttaataga

SEQ ID NO: 4212 - DNA, 10 bp, Saccharomyces cerevisiae
cgtttgtaaa

SEQ ID NO: 4213 - DNA, 10 bp, Saccharomyces cerevisiae
cgtttgtgta

SEQ ID NO: 4214 - DNA, 10 bp, Saccharomyces cerevisiae
cgttttcgtc

SEQ ID NO: 4215 - DNA, 10 bp, Saccharomyces cerevisiae
cgttttttca

SEQ ID NO: 4216 - DNA, 10 bp, Saccharomyces cerevisiae
ctaaacaaag

SEQ ID NO: 4217 - DNA, 10 bp, Saccharomyces cerevisiae
ctaaatcttg

SEQ ID NO: 4218 - DNA, 10 bp, Saccharomyces cerevisiae
ctaactaagc

SEQ ID NO: 4219 - DNA, 10 bp, Saccharomyces cerevisiae
ctaagaatga

SEQ ID NO: 4220 - DNA, 10 bp, Saccharomyces cerevisiae
ctaatacaaa

SEQ ID NO: 4221 - DNA, 10 bp, Saccharomyces cerevisiae
ctaatatgtg

SEQ ID NO: 4222 - DNA, 10 bp, Saccharomyces cerevisiae
ctaatcactg

SEQ ID NO: 4223 - DNA, 10 bp, Saccharomyces cerevisiae
ctaatcattt

SEQ ID NO: 4224 - DNA, 10 bp, Saccharomyces cerevisiae
ctacataaat

SEQ ID NO: 4225 - DNA, 10 bp, Saccharomyces cerevisiae
ctaccactac

SEQ ID NO: 4226 - DNA, 10 bp, Saccharomyces cerevisiae
ctagcgtttg

SEQ ID NO: 4227 - DNA, 10 bp, Saccharomyces cerevisiae
ctataaaaca

SEQ ID NO: 4228 - DNA, 10 bp, Saccharomyces cerevisiae
ctatatatca

SEQ ID NO: 4229 - DNA, 10 bp, Saccharomyces cerevisiae
ctatcggcca

SEQ ID NO: 4230 - DNA, 10 bp, Saccharomyces cerevisiae
ctatgccaaa

SEQ ID NO: 4231 - DNA, 10 bp, Saccharomyces cerevisiae
ctatttatga

SEQ ID NO: 4232 - DNA, 10 bp, Saccharomyces cerevisiae
ctatttctca

SEQ ID NO: 4233 - DNA, 10 bp, Saccharomyces cerevisiae
ctcaaactgc

SEQ ID NO: 4234 - DNA, 10 bp, Saccharomyces cerevisiae
ctcaaattga

SEQ ID NO: 4235 - DNA, 10 bp, Saccharomyces cerevisiae
ctcacgggaa

SEQ ID NO: 4236 - DNA, 10 bp, Saccharomyces cerevisiae
ctcagcagca

SEQ ID NO: 4237 - DNA, 10 bp, Saccharomyces cerevisiae
ctcaggatga

SEQ ID NO: 4238 - DNA, 10 bp, Saccharomyces cerevisiae
ctccaaaatg

SEQ ID NO: 4239 - DNA, 10 bp, Saccharomyces cerevisiae
ctccagaaga

SEQ ID NO: 4240 - DNA, 10 bp, Saccharomyces cerevisiae
ctccatacac

SEQ ID NO: 4241 - DNA, 10 bp, Saccharomyces cerevisiae
ctcgttcact

SEQ ID NO: 4242 - DNA, 10 bp, Saccharomyces cerevisiae
ctctaaattt

SEQ ID NO: 4243 - DNA, 10 bp, Saccharomyces cerevisiae
ctctacttat

SEQ ID NO: 4244 - DNA, 10 bp, Saccharomyces cerevisiae
ctctattatt

SEQ ID NO: 4245 - DNA, 10 bp, Saccharomyces cerevisiae
ctctattgat

SEQ ID NO: 4246 - DNA, 10 bp, Saccharomyces cerevisiae
ctctccaatc

SEQ ID NO: 4247 - DNA, 10 bp, Saccharomyces cerevisiae
ctctccccca

SEQ ID NO: 4248 - DNA, 10 bp, Saccharomyces cerevisiae
ctctcctatt

SEQ ID NO: 4249 - DNA, 10 bp, Saccharomyces cerevisiae
ctctgttgcg

SEQ ID NO: 4250 - DNA, 10 bp, Saccharomyces cerevisiae
ctcttagttg

SEQ ID NO: 4251 - DNA, 10 bp, Saccharomyces cerevisiae
ctcttgattt

SEQ ID NO: 4252 - DNA, 10 bp, Saccharomyces cerevisiae
ctcttgccaa

SEQ ID NO: 4253 - DNA, 10 bp, Saccharomyces cerevisiae
ctgaaggaaa

SEQ ID NO: 4254 - DNA, 10 bp, Saccharomyces cerevisiae
ctgacactag

SEQ ID NO: 4255 - DNA, 10 bp, Saccharomyces cerevisiae
ctgataaagg

SEQ ID NO: 4256 - DNA, 10 bp, Saccharomyces cerevisiae
ctgatatctt

SEQ ID NO: 4257 - DNA, 10 bp, Saccharomyces cerevisiae
ctgatccgcg

SEQ ID NO: 4258 - DNA, 10 bp, Saccharomyces cerevisiae
ctgcacgaat

SEQ ID NO: 4259 - DNA, 10 bp, Saccharomyces cerevisiae
ctgccgaaga

SEQ ID NO: 4260 - DNA, 10 bp, Saccharomyces cerevisiae
ctgcctttct

SEQ ID NO: 4261 - DNA, 10 bp, Saccharomyces cerevisiae
ctgcgtttat

SEQ ID NO: 4262 - DNA, 10 bp, Saccharomyces cerevisiae
ctgctaagcg

SEQ ID NO: 4263 - DNA, 10 bp, Saccharomyces cerevisiae
ctgctccggg

SEQ ID NO: 4264 - DNA, 10 bp, Saccharomyces cerevisiae
ctgctgttcg

SEQ ID NO: 4265 - DNA, 10 bp, Saccharomyces cerevisiae
ctgcttccta

SEQ ID NO: 4266 - DNA, 10 bp, Saccharomyces cerevisiae
ctggatgatc

SEQ ID NO: 4267 - DNA, 10 bp, Saccharomyces cerevisiae
ctggcaacca

SEQ ID NO: 4268 - DNA, 10 bp, Saccharomyces cerevisiae
ctggcagaat

SEQ ID NO: 4269 - DNA, 10 bp, Saccharomyces cerevisiae
ctggcagacc

SEQ ID NO: 4270 - DNA, 10 bp, Saccharomyces cerevisiae
ctggcgaacg

SEQ ID NO: 4271 - DNA, 10 bp, Saccharomyces cerevisiae
ctggctcttt

SEQ ID NO: 4272 - DNA, 10 bp, Saccharomyces cerevisiae
ctggcttggc

SEQ ID NO: 4273 - DNA, 10 bp, Saccharomyces cerevisiae
ctgggttcta

SEQ ID NO: 4274 - DNA, 10 bp, Saccharomyces cerevisiae
ctggtcgcga

SEQ ID NO: 4275 - DNA, 10 bp, Saccharomyces cerevisiae
ctgtataata

SEQ ID NO: 4276 - DNA, 10 bp, Saccharomyces cerevisiae
ctgttatcat

SEQ ID NO: 4277 - DNA, 10 bp, Saccharomyces cerevisiae
ctgttttagt

SEQ ID NO: 4278 - DNA, 10 bp, Saccharomyces cerevisiae
cttaaaaaaa

SEQ ID NO: 4279 - DNA, 10 bp, Saccharomyces cerevisiae
cttaacaaga

SEQ ID NO: 4280 - DNA, 10 bp, Saccharomyces cerevisiae
cttaagaacg

SEQ ID NO: 4281 - DNA, 10 bp, Saccharomyces cerevisiae
cttaatgtgt

SEQ ID NO: 4282 - DNA, 10 bp, Saccharomyces cerevisiae
cttagggaac

SEQ ID NO: 4283 - DNA, 10 bp, Saccharomyces cerevisiae
cttatggaga

SEQ ID NO: 4284 - DNA, 10 bp, Saccharomyces cerevisiae
cttatttttt

SEQ ID NO: 4285 - DNA, 10 bp, Saccharomyces cerevisiae
cttcagaatg

SEQ ID NO: 4286 - DNA, 10 bp, Saccharomyces cerevisiae
cttcagccca

SEQ ID NO: 4287 - DNA, 10 bp, Saccharomyces cerevisiae
cttccaaaag

SEQ ID NO: 4288 - DNA, 10 bp, Saccharomyces cerevisiae
cttcccaaat

SEQ ID NO: 4289 - DNA, 10 bp, Saccharomyces cerevisiae
cttcgttacc

SEQ ID NO: 4290 - DNA, 10 bp, Saccharomyces cerevisiae
cttctccttt

SEQ ID NO: 4291 - DNA, 10 bp, Saccharomyces cerevisiae
cttcttccgc

SEQ ID NO: 4292 - DNA, 10 bp, Saccharomyces cerevisiae
cttgagctag

SEQ ID NO: 4293 - DNA, 10 bp, Saccharomyces cerevisiae
cttgatatct

SEQ ID NO: 4294 - DNA, 10 bp, Saccharomyces cerevisiae
cttgattagt

SEQ ID NO: 4295 - DNA, 10 bp, Saccharomyces cerevisiae
cttgcgtgga

SEQ ID NO: 4296 - DNA, 10 bp, Saccharomyces cerevisiae
cttgtcgcac

SEQ ID NO: 4297 - DNA, 10 bp, Saccharomyces cerevisiae
cttgtctttg

SEQ ID NO: 4298 - DNA, 10 bp, Saccharomyces cerevisiae
cttgttcaaa

SEQ ID NO: 4299 - DNA, 10 bp, Saccharomyces cerevisiae
cttgttgttc

SEQ ID NO: 4300 - DNA, 10 bp, Saccharomyces cerevisiae
ctttagaaga

SEQ ID NO: 4301 - DNA, 10 bp, Saccharomyces cerevisiae
ctttcctctt

SEQ ID NO: 4302 - DNA, 10 bp, Saccharomyces cerevisiae
ctttcgtttt

SEQ ID NO: 4303 - DNA, 10 bp, Saccharomyces cerevisiae
ctttttctgt

SEQ ID NO: 4304 - DNA, 10 bp, Saccharomyces cerevisiae
ctttttgaca

SEQ ID NO: 4305 - DNA, 10 bp, Saccharomyces cerevisiae
cttttttgag

SEQ ID NO: 4306 - DNA, 10 bp, Saccharomyces cerevisiae
gaaaaaaagc

SEQ ID NO: 4307 - DNA, 10 bp, Saccharomyces cerevisiae
gaaaacacgt

SEQ ID NO: 4308 - DNA, 10 bp, Saccharomyces cerevisiae
gaaaacgttc

SEQ ID NO: 4309 - DNA, 10 bp, Saccharomyces cerevisiae
gaaaatgaaa

SEQ ID NO: 4310 - DNA, 10 bp, Saccharomyces cerevisiae
gaaaattatt

SEQ ID NO: 4311 - DNA, 10 bp, Saccharomyces cerevisiae
gaaaattgga

SEQ ID NO: 4312 - DNA, 10 bp, Saccharomyces cerevisiae
gaaaattggg

SEQ ID NO: 4313 - DNA, 10 bp, Saccharomyces cerevisiae
gaaacaaggt

SEQ ID NO: 4314 - DNA, 10 bp, Saccharomyces cerevisiae
gaaacgctct

SEQ ID NO: 4315 - DNA, 10 bp, Saccharomyces cerevisiae
gaaacgttgt

SEQ ID NO: 4316 - DNA, 10 bp, Saccharomyces cerevisiae
gaaagataat

SEQ ID NO: 4317 - DNA, 10 bp, Saccharomyces cerevisiae
gaaagcataa

SEQ ID NO: 4318 - DNA, 10 bp, Saccharomyces cerevisiae
gaaagtttga

SEQ ID NO: 4319 - DNA, 10 bp, Saccharomyces cerevisiae
gaaatgtgga

SEQ ID NO: 4320 - DNA, 10 bp, Saccharomyces cerevisiae
gaaattgaaa

SEQ ID NO: 4321 - DNA, 10 bp, Saccharomyces cerevisiae
gaacaaaacg

SEQ ID NO: 4322 - DNA, 10 bp, Saccharomyces cerevisiae
gaacaatctt

SEQ ID NO: 4323 - DNA, 10 bp, Saccharomyces cerevisiae
gaacaattcg

SEQ ID NO: 4324 - DNA, 10 bp, Saccharomyces cerevisiae
gaacagcaga

SEQ ID NO: 4325 - DNA, 10 bp, Saccharomyces cerevisiae
gaacagcagg

SEQ ID NO: 4326 - DNA, 10 bp, Saccharomyces cerevisiae
gaacgagaag

SEQ ID NO: 4327 - DNA, 10 bp, Saccharomyces cerevisiae
gaacgatcct

SEQ ID NO: 4328 - DNA, 10 bp, Saccharomyces cerevisiae
gaacgtatat

SEQ ID NO: 4329 - DNA, 10 bp, Saccharomyces cerevisiae
gaactcctgg

SEQ ID NO: 4330 - DNA, 10 bp, Saccharomyces cerevisiae
gaactgaaaa

SEQ ID NO: 4331 - DNA, 10 bp, Saccharomyces cerevisiae
gaacttgtta

SEQ ID NO: 4332 - DNA, 10 bp, Saccharomyces cerevisiae
gaagaatcag

SEQ ID NO: 4333 - DNA, 10 bp, Saccharomyces cerevisiae
gaagacagcg

SEQ ID NO: 4334 - DNA, 10 bp, Saccharomyces cerevisiae
gaagctccca

SEQ ID NO: 4335 - DNA, 10 bp, Saccharomyces cerevisiae
gaaggcgttt

SEQ ID NO: 4336 - DNA, 10 bp, Saccharomyces cerevisiae
gaaggtagat

SEQ ID NO: 4337 - DNA, 10 bp, Saccharomyces cerevisiae
gaaggttggt

SEQ ID NO: 4338 - DNA, 10 bp, Saccharomyces cerevisiae
gaagtagaaa

SEQ ID NO: 4339 - DNA, 10 bp, Saccharomyces cerevisiae
gaagtgatat

SEQ ID NO: 4340 - DNA, 10 bp, Saccharomyces cerevisiae
gaagttcagt

SEQ ID NO: 4341 - DNA, 10 bp, Saccharomyces cerevisiae
gaataacgaa

SEQ ID NO: 4342 - DNA, 10 bp, Saccharomyces cerevisiae
gaataatgtc

SEQ ID NO: 4343 - DNA, 10 bp, Saccharomyces cerevisiae
gaatgggact

SEQ ID NO: 4344 - DNA, 10 bp, Saccharomyces cerevisiae
gaatgttcat

SEQ ID NO: 4345 - DNA, 10 bp, Saccharomyces cerevisiae
gaattgagca

SEQ ID NO: 4346 - DNA, 10 bp, Saccharomyces cerevisiae
gaattgtggc

SEQ ID NO: 4347 - DNA, 10 bp, Saccharomyces cerevisiae
gaattttaga

SEQ ID NO: 4348 - DNA, 10 bp, Saccharomyces cerevisiae
gacaaagaca

SEQ ID NO: 4349 - DNA, 10 bp, Saccharomyces cerevisiae
gacaacaaga

SEQ ID NO: 4350 - DNA, 10 bp, Saccharomyces cerevisiae
gacaacaccc

SEQ ID NO: 4351 - DNA, 10 bp, Saccharomyces cerevisiae
gacaacgtgg

SEQ ID NO: 4352 - DNA, 10 bp, Saccharomyces cerevisiae
gacaagcttg

SEQ ID NO: 4353 - DNA, 10 bp, Saccharomyces cerevisiae
gacaaggatg

SEQ ID NO: 4354 - DNA, 10 bp, Saccharomyces cerevisiae
gacaattttt

SEQ ID NO: 4355 - DNA, 10 bp, Saccharomyces cerevisiae
gacacctatg

SEQ ID NO: 4356 - DNA, 10 bp, Saccharomyces cerevisiae
gacacttctc

SEQ ID NO: 4357 - DNA, 10 bp, Saccharomyces cerevisiae
gacatagaaa

SEQ ID NO: 4358 - DNA, 10 bp, Saccharomyces cerevisiae
gacatcaagc

SEQ ID NO: 4359 - DNA, 10 bp, Saccharomyces cerevisiae
gacatcagtt

SEQ ID NO: 4360 - DNA, 10 bp, Saccharomyces cerevisiae
gacatttcct

SEQ ID NO: 4361 - DNA, 10 bp, Saccharomyces cerevisiae
gacatttgaa

SEQ ID NO: 4362 - DNA, 10 bp, Saccharomyces cerevisiae
gaccaatatc

SEQ ID NO: 4363 - DNA, 10 bp, Saccharomyces cerevisiae
gacccaggca

SEQ ID NO: 4364 - DNA, 10 bp, Saccharomyces cerevisiae
gacgaatatt

SEQ ID NO: 4365 - DNA, 10 bp, Saccharomyces cerevisiae
gacgcttcac

SEQ ID NO: 4366 - DNA, 10 bp, Saccharomyces cerevisiae
gacgtccaac

SEQ ID NO: 4367 - DNA, 10 bp, Saccharomyces cerevisiae
gactaatgta

SEQ ID NO: 4368 - DNA, 10 bp, Saccharomyces cerevisiae
gactatttag

SEQ ID NO: 4369 - DNA, 10 bp, Saccharomyces cerevisiae
gactcaaaat

SEQ ID NO: 4370 - DNA, 10 bp, Saccharomyces cerevisiae
gactcgataa

SEQ ID NO: 4371 - DNA, 10 bp, Saccharomyces cerevisiae
gactcgcttt

SEQ ID NO: 4372 - DNA, 10 bp, Saccharomyces cerevisiae
gactctattg

SEQ ID NO: 4373 - DNA, 10 bp, Saccharomyces cerevisiae
gactgaagct

SEQ ID NO: 4374 - DNA, 10 bp, Saccharomyces cerevisiae
gactgatacg

SEQ ID NO: 4375 - DNA, 10 bp, Saccharomyces cerevisiae
gacttcataa

SEQ ID NO: 4376 - DNA, 10 bp, Saccharomyces cerevisiae
gacttctttc

SEQ ID NO: 4377 - DNA, 10 bp, Saccharomyces cerevisiae
gagaaagaaa

SEQ ID NO: 4378 - DNA, 10 bp, Saccharomyces cerevisiae
gagaactcac

SEQ ID NO: 4379 - DNA, 10 bp, Saccharomyces cerevisiae
gagaagacag

SEQ ID NO: 4380 - DNA, 10 bp, Saccharomyces cerevisiae
gagactttta

SEQ ID NO: 4381 - DNA, 10 bp, Saccharomyces cerevisiae
gagagatgaa

SEQ ID NO: 4382 - DNA, 10 bp, Saccharomyces cerevisiae
gagagcaacg

SEQ ID NO: 4383 - DNA, 10 bp, Saccharomyces cerevisiae
gagagttcga

SEQ ID NO: 4384 - DNA, 10 bp, Saccharomyces cerevisiae
gagatgttcc

SEQ ID NO: 4385 - DNA, 10 bp, Saccharomyces cerevisiae
gagcaggtgg

SEQ ID NO: 4386 - DNA, 10 bp, Saccharomyces cerevisiae
gagctccgat

SEQ ID NO: 4387 - DNA, 10 bp, Saccharomyces cerevisiae
gaggatagcc

SEQ ID NO: 4388 - DNA, 10 bp, Saccharomyces cerevisiae
gaggatagcg

SEQ ID NO: 4389 - DNA, 10 bp, Saccharomyces cerevisiae
gaggcaaaaa

SEQ ID NO: 4390 - DNA, 10 bp, Saccharomyces cerevisiae
gaggcgagat

SEQ ID NO: 4391 - DNA, 10 bp, Saccharomyces cerevisiae
gagggctcag

SEQ ID NO: 4392 - DNA, 10 bp, Saccharomyces cerevisiae
gaggtaaagg

SEQ ID NO: 4393 - DNA, 10 bp, Saccharomyces cerevisiae
gaggtcaaga

SEQ ID NO: 4394 - DNA, 10 bp, Saccharomyces cerevisiae
gaggttaacc

SEQ ID NO: 4395 - DNA, 10 bp, Saccharomyces cerevisiae
gagtggcctt

SEQ ID NO: 4396 - DNA, 10 bp, Saccharomyces cerevisiae
gagtgggtta

SEQ ID NO: 4397 - DNA, 10 bp, Saccharomyces cerevisiae
gagtgttaca

SEQ ID NO: 4398 - DNA, 10 bp, Saccharomyces cerevisiae
gagttagtgt

SEQ ID NO: 4399 - DNA, 10 bp, Saccharomyces cerevisiae
gagttgataa

SEQ ID NO: 4400 - DNA, 10 bp, Saccharomyces cerevisiae
gagtttgcta

SEQ ID NO: 4401 - DNA, 10 bp, Saccharomyces cerevisiae
gataaaaaag

SEQ ID NO: 4402 - DNA, 10 bp, Saccharomyces cerevisiae
gataactgaa

SEQ ID NO: 4403 - DNA, 10 bp, Saccharomyces cerevisiae
gataagcccg

SEQ ID NO: 4404 - DNA, 10 bp, Saccharomyces cerevisiae
gataatcgca

SEQ ID NO: 4405 - DNA, 10 bp, Saccharomyces cerevisiae
gataccttca

SEQ ID NO: 4406 - DNA, 10 bp, Saccharomyces cerevisiae
gatatatcat

SEQ ID NO: 4407 - DNA, 10 bp, Saccharomyces cerevisiae
gatatgccga

SEQ ID NO: 4408 - DNA, 10 bp, Saccharomyces cerevisiae
gatatttttt

SEQ ID NO: 4409 - DNA, 10 bp, Saccharomyces cerevisiae
gatccagatg

SEQ ID NO: 4410 - DNA, 10 bp, Saccharomyces cerevisiae
gatcgccgct

SEQ ID NO: 4411 - DNA, 10 bp, Saccharomyces cerevisiae
gatctcaatt

SEQ ID NO: 4412 - DNA, 10 bp, Saccharomyces cerevisiae
gatgaaaaca

SEQ ID NO: 4413 - DNA, 10 bp, Saccharomyces cerevisiae
gatgaagacg

SEQ ID NO: 4414 - DNA, 10 bp, Saccharomyces cerevisiae
gatgaatacc

SEQ ID NO: 4415 - DNA, 10 bp, Saccharomyces cerevisiae
gatgatgatg

SEQ ID NO: 4416 - DNA, 10 bp, Saccharomyces cerevisiae
gatgcaaatc

SEQ ID NO: 4417 - DNA, 10 bp, Saccharomyces cerevisiae
gatggaatag

SEQ ID NO: 4418 - DNA, 10 bp, Saccharomyces cerevisiae
gatgtccaga

SEQ ID NO: 4419 - DNA, 10 bp, Saccharomyces cerevisiae
gattacttca

SEQ ID NO: 4420 - DNA, 10 bp, Saccharomyces cerevisiae
gattcaaaaa

SEQ ID NO: 4421 - DNA, 10 bp, Saccharomyces cerevisiae
gattcgatac

SEQ ID NO: 4422 - DNA, 10 bp, Saccharomyces cerevisiae
gattctaaaa

SEQ ID NO: 4423 - DNA, 10 bp, Saccharomyces cerevisiae
gattctgact

SEQ ID NO: 4424 - DNA, 10 bp, Saccharomyces cerevisiae
gattgcgatc

SEQ ID NO: 4425 - DNA, 10 bp, Saccharomyces cerevisiae
gattggaaat

SEQ ID NO: 4426 - DNA, 10 bp, Saccharomyces cerevisiae
gattggtggt

SEQ ID NO: 4427 - DNA, 10 bp, Saccharomyces cerevisiae
gattgtggat

SEQ ID NO: 4428 - DNA, 10 bp, Saccharomyces cerevisiae
gatttggcgc

SEQ ID NO: 4429 - DNA, 10 bp, Saccharomyces cerevisiae
gcaaacccaa

SEQ ID NO: 4430 - DNA, 10 bp, Saccharomyces cerevisiae
gcaaacccac

SEQ ID NO: 4431 - DNA, 10 bp, Saccharomyces cerevisiae
gcaaagaata

SEQ ID NO: 4432 - DNA, 10 bp, Saccharomyces cerevisiae
gcaaatgatt

SEQ ID NO: 4433 - DNA, 10 bp, Saccharomyces cerevisiae
gcaactgcgg

SEQ ID NO: 4434 - DNA, 10 bp, Saccharomyces cerevisiae
gcaagagaag

SEQ ID NO: 4435 - DNA, 10 bp, Saccharomyces cerevisiae
gcaagttagc

SEQ ID NO: 4436 - DNA, 10 bp, Saccharomyces cerevisiae
gcaatactat

SEQ ID NO: 4437 - DNA, 10 bp, Saccharomyces cerevisiae
gcaatgacac

SEQ ID NO: 4438 - DNA, 10 bp, Saccharomyces cerevisiae
gcacattcga

SEQ ID NO: 4439 - DNA, 10 bp, Saccharomyces cerevisiae
gcacgaagta

SEQ ID NO: 4440 - DNA, 10 bp, Saccharomyces cerevisiae
gcacttcaac

SEQ ID NO: 4441 - DNA, 10 bp, Saccharomyces cerevisiae
gcagatagcg

SEQ ID NO: 4442 - DNA, 10 bp, Saccharomyces cerevisiae
gcagccattg

SEQ ID NO: 4443 - DNA, 10 bp, Saccharomyces cerevisiae
gcagttgcct

SEQ ID NO: 4444 - DNA, 10 bp, Saccharomyces cerevisiae
gcagttgctt

SEQ ID NO: 4445 - DNA, 10 bp, Saccharomyces cerevisiae
gcataaaacg

SEQ ID NO: 4446 - DNA, 10 bp, Saccharomyces cerevisiae
gcataacgag

SEQ ID NO: 4447 - DNA, 10 bp, Saccharomyces cerevisiae
gcatcaacaa

SEQ ID NO: 4448 - DNA, 10 bp, Saccharomyces cerevisiae
gcatcattga

SEQ ID NO: 4449 - DNA, 10 bp, Saccharomyces cerevisiae
gcatccaaga

SEQ ID NO: 4450 - DNA, 10 bp, Saccharomyces cerevisiae
gcatctctaa

SEQ ID NO: 4451 - DNA, 10 bp, Saccharomyces cerevisiae
gcattccttg

SEQ ID NO: 4452 - DNA, 10 bp, Saccharomyces cerevisiae
gcatttgatt

SEQ ID NO: 4453 - DNA, 10 bp, Saccharomyces cerevisiae
gcattttatc

SEQ ID NO: 4454 - DNA, 10 bp, Saccharomyces cerevisiae
gccaaactga

SEQ ID NO: 4455 - DNA, 10 bp, Saccharomyces cerevisiae
gccaaatcat

SEQ ID NO: 4456 - DNA, 10 bp, Saccharomyces cerevisiae
gccaaatgtt

SEQ ID NO: 4457 - DNA, 10 bp, Saccharomyces cerevisiae
gccaacgccg

SEQ ID NO: 4458 - DNA, 10 bp, Saccharomyces cerevisiae
gccaagaact

SEQ ID NO: 4459 - DNA, 10 bp, Saccharomyces cerevisiae
gccaatcaca

SEQ ID NO: 4460 - DNA, 10 bp, Saccharomyces cerevisiae
gccagaaacg

SEQ ID NO: 4461 - DNA, 10 bp, Saccharomyces cerevisiae
gccagattgg

SEQ ID NO: 4462 - DNA, 10 bp, Saccharomyces cerevisiae
gccagattta

SEQ ID NO: 4463 - DNA, 10 bp, Saccharomyces cerevisiae
gccagtggcg

SEQ ID NO: 4464 - DNA, 10 bp, Saccharomyces cerevisiae
gccatttttg

SEQ ID NO: 4465 - DNA, 10 bp, Saccharomyces cerevisiae
gcccaactca

SEQ ID NO: 4466 - DNA, 10 bp, Saccharomyces cerevisiae
gcccttccta

SEQ ID NO: 4467 - DNA, 10 bp, Saccharomyces cerevisiae
gccgaattct

SEQ ID NO: 4468 - DNA, 10 bp, Saccharomyces cerevisiae
gccgatgtgc

SEQ ID NO: 4469 - DNA, 10 bp, Saccharomyces cerevisiae
gccggttcac

SEQ ID NO: 4470 - DNA, 10 bp, Saccharomyces cerevisiae
gcctagtaat

SEQ ID NO: 4471 - DNA, 10 bp, Saccharomyces cerevisiae
gcctgaaatg

SEQ ID NO: 4472 - DNA, 10 bp, Saccharomyces cerevisiae
gcctgcaaat

SEQ ID NO: 4473 - DNA, 10 bp, Saccharomyces cerevisiae
gcctgggaag

SEQ ID NO: 4474 - DNA, 10 bp, Saccharomyces cerevisiae
gcctgggata

SEQ ID NO: 4475 - DNA, 10 bp, Saccharomyces cerevisiae
gccttgggta

SEQ ID NO: 4476 - DNA, 10 bp, Saccharomyces cerevisiae
gccttttttt

SEQ ID NO: 4477 - DNA, 10 bp, Saccharomyces cerevisiae
gcgaatagtg

SEQ ID NO: 4478 - DNA, 10 bp, Saccharomyces cerevisiae
gcgatactac

SEQ ID NO: 4479 - DNA, 10 bp, Saccharomyces cerevisiae
gcgatcaaaa

SEQ ID NO: 4480 - DNA, 10 bp, Saccharomyces cerevisiae
gcgatctctt

SEQ ID NO: 4481 - DNA, 10 bp, Saccharomyces cerevisiae
gcgcctctca

SEQ ID NO: 4482 - DNA, 10 bp, Saccharomyces cerevisiae
gcgctactgc

SEQ ID NO: 4483 - DNA, 10 bp, Saccharomyces cerevisiae
gcgctcaaaa

SEQ ID NO: 4484 - DNA, 10 bp, Saccharomyces cerevisiae
gcggcgggtg

SEQ ID NO: 4485 - DNA, 10 bp, Saccharomyces cerevisiae
gcgtaccggc

SEQ ID NO: 4486 - DNA, 10 bp, Saccharomyces cerevisiae
gcgtcctccc

SEQ ID NO: 4487 - DNA, 10 bp, Saccharomyces cerevisiae
gcgtctttta

SEQ ID NO: 4488 - DNA, 10 bp, Saccharomyces cerevisiae
gctaatacat

SEQ ID NO: 4489 - DNA, 10 bp, Saccharomyces cerevisiae
gctacagcag

SEQ ID NO: 4490 - DNA, 10 bp, Saccharomyces cerevisiae
gctacccaat

SEQ ID NO: 4491 - DNA, 10 bp, Saccharomyces cerevisiae
gctacctaaa

SEQ ID NO: 4492 - DNA, 10 bp, Saccharomyces cerevisiae
gctacctacg

SEQ ID NO: 4493 - DNA, 10 bp, Saccharomyces cerevisiae
gctactatta

SEQ ID NO: 4494 - DNA, 10 bp, Saccharomyces cerevisiae
gctcaaattg

SEQ ID NO: 4495 - DNA, 10 bp, Saccharomyces cerevisiae
gctcaatcca

SEQ ID NO: 4496 - DNA, 10 bp, Saccharomyces cerevisiae
gctctaaaaa

SEQ ID NO: 4497 - DNA, 10 bp, Saccharomyces cerevisiae
gctgagcccg

SEQ ID NO: 4498 - DNA, 10 bp, Saccharomyces cerevisiae
gctgctacgc

SEQ ID NO: 4499 - DNA, 10 bp, Saccharomyces cerevisiae
gctgctaggc

SEQ ID NO: 4500 - DNA, 10 bp, Saccharomyces cerevisiae
gctgctcaat

SEQ ID NO: 4501 - DNA, 10 bp, Saccharomyces cerevisiae
gctgctcaga

SEQ ID NO: 4502 - DNA, 10 bp, Saccharomyces cerevisiae
gctggctaag

SEQ ID NO: 4503 - DNA, 10 bp, Saccharomyces cerevisiae
gctggtagta

SEQ ID NO: 4504 - DNA, 10 bp, Saccharomyces cerevisiae
gctgtattct

SEQ ID NO: 4505 - DNA, 10 bp, Saccharomyces cerevisiae
gctgttttca

SEQ ID NO: 4506 - DNA, 10 bp, Saccharomyces cerevisiae
gcttaaaaaa

SEQ ID NO: 4507 - DNA, 10 bp, Saccharomyces cerevisiae
gcttaaaaat

SEQ ID NO: 4508 - DNA, 10 bp, Saccharomyces cerevisiae
gcttcgaaca

SEQ ID NO: 4509 - DNA, 10 bp, Saccharomyces cerevisiae
gcttcttata

SEQ ID NO: 4510 - DNA, 10 bp, Saccharomyces cerevisiae
gcttggcggt

SEQ ID NO: 4511 - DNA, 10 bp, Saccharomyces cerevisiae
gcttgtactt

SEQ ID NO: 4512 - DNA, 10 bp, Saccharomyces cerevisiae
gctttccttt

SEQ ID NO: 4513 - DNA, 10 bp, Saccharomyces cerevisiae
gctttgctaa

SEQ ID NO: 4514 - DNA, 10 bp, Saccharomyces cerevisiae
gctttgttgt

SEQ ID NO: 4515 - DNA, 10 bp, Saccharomyces cerevisiae
gctttttgca

SEQ ID NO: 4516 - DNA, 10 bp, Saccharomyces cerevisiae
ggaaaaatta

SEQ ID NO: 4517 - DNA, 10 bp, Saccharomyces cerevisiae
ggaaaatgct

SEQ ID NO: 4518 - DNA, 10 bp, Saccharomyces cerevisiae
ggaaagccca

SEQ ID NO: 4519 - DNA, 10 bp, Saccharomyces cerevisiae
ggaacacttc

SEQ ID NO: 4520 - DNA, 10 bp, Saccharomyces cerevisiae
ggaaccttcg

SEQ ID NO: 4521 - DNA, 10 bp, Saccharomyces cerevisiae
ggaatccata

SEQ ID NO: 4522 - DNA, 10 bp, Saccharomyces cerevisiae
ggaatctggt

SEQ ID NO: 4523 - DNA, 10 bp, Saccharomyces cerevisiae
ggaatgttga

SEQ ID NO: 4524 - DNA, 10 bp, Saccharomyces cerevisiae
ggaattaaga

SEQ ID NO: 4525 - DNA, 10 bp, Saccharomyces cerevisiae
ggaccccact

SEQ ID NO: 4526 - DNA, 10 bp, Saccharomyces cerevisiae
ggaccttact

SEQ ID NO: 4527 - DNA, 10 bp, Saccharomyces cerevisiae
ggactcatat

SEQ ID NO: 4528 - DNA, 10 bp, Saccharomyces cerevisiae
ggagcagtta

SEQ ID NO: 4529 - DNA, 10 bp, Saccharomyces cerevisiae
ggagccctga

SEQ ID NO: 4530 - DNA, 10 bp, Saccharomyces cerevisiae
ggagcgtata

SEQ ID NO: 4531 - DNA, 10 bp, Saccharomyces cerevisiae
ggaggaaacc

SEQ ID NO: 4532 - DNA, 10 bp, Saccharomyces cerevisiae
ggaggatggg

SEQ ID NO: 4533 - DNA, 10 bp, Saccharomyces cerevisiae
ggagggaacg

SEQ ID NO: 4534 - DNA, 10 bp, Saccharomyces cerevisiae
ggagtgcaac

SEQ ID NO: 4535 - DNA, 10 bp, Saccharomyces cerevisiae
ggagttaacg

SEQ ID NO: 4536 - DNA, 10 bp, Saccharomyces cerevisiae
ggatagcact

SEQ ID NO: 4537 - DNA, 10 bp, Saccharomyces cerevisiae
ggatgatgga

SEQ ID NO: 4538 - DNA, 10 bp, Saccharomyces cerevisiae
ggatggcgac

SEQ ID NO: 4539 - DNA, 10 bp, Saccharomyces cerevisiae
ggatggtaag

SEQ ID NO: 4540 - DNA, 10 bp, Saccharomyces cerevisiae
ggatttggac

SEQ ID NO: 4541 - DNA, 10 bp, Saccharomyces cerevisiae
ggcaaatcca

SEQ ID NO: 4542 - DNA, 10 bp, Saccharomyces cerevisiae
ggcaacggtg

SEQ ID NO: 4543 - DNA, 10 bp, Saccharomyces cerevisiae
ggcaatagcc

SEQ ID NO: 4544 - DNA, 10 bp, Saccharomyces cerevisiae
ggcacctgtc

SEQ ID NO: 4545 - DNA, 10 bp, Saccharomyces cerevisiae
ggcagatgat

SEQ ID NO: 4546 - DNA, 10 bp, Saccharomyces cerevisiae
ggcagattgg

SEQ ID NO: 4547 - DNA, 10 bp, Saccharomyces cerevisiae
ggcataaacg

SEQ ID NO: 4548 - DNA, 10 bp, Saccharomyces cerevisiae
ggcatcagga

SEQ ID NO: 4549 - DNA, 10 bp, Saccharomyces cerevisiae
ggcccataga

SEQ ID NO: 4550 - DNA, 10 bp, Saccharomyces cerevisiae
ggcctaccac

SEQ ID NO: 4551 - DNA, 10 bp, Saccharomyces cerevisiae
ggcgattgat

SEQ ID NO: 4552 - DNA, 10 bp, Saccharomyces cerevisiae
ggcgctaaga

SEQ ID NO: 4553 - DNA, 10 bp, Saccharomyces cerevisiae
ggcgctaatt

SEQ ID NO: 4554 - DNA, 10 bp, Saccharomyces cerevisiae
ggcggtggtg

SEQ ID NO: 4555 - DNA, 10 bp, Saccharomyces cerevisiae
ggcgtagaat

SEQ ID NO: 4556 - DNA, 10 bp, Saccharomyces cerevisiae
ggcgttgaca

SEQ ID NO: 4557 - DNA, 10 bp, Saccharomyces cerevisiae
ggctctcccc

SEQ ID NO: 4558 - DNA, 10 bp, Saccharomyces cerevisiae
ggctgagata

SEQ ID NO: 4559 - DNA, 10 bp, Saccharomyces cerevisiae
ggctgtttgg

SEQ ID NO: 4560 - DNA, 10 bp, Saccharomyces cerevisiae
ggcttctcta

SEQ ID NO: 4561 - DNA, 10 bp, Saccharomyces cerevisiae
ggctttacaa

SEQ ID NO: 4562 - DNA, 10 bp, Saccharomyces cerevisiae
ggctttggtt

SEQ ID NO: 4563 - DNA, 10 bp, Saccharomyces cerevisiae
gggactgatg

SEQ ID NO: 4564 - DNA, 10 bp, Saccharomyces cerevisiae
gggagaaatc

SEQ ID NO: 4565 - DNA, 10 bp, Saccharomyces cerevisiae
gggagctcaa

SEQ ID NO: 4566 - DNA, 10 bp, Saccharomyces cerevisiae
gggaggtcat

SEQ ID NO: 4567 - DNA, 10 bp, Saccharomyces cerevisiae
gggatgatga

SEQ ID NO: 4568 - DNA, 10 bp, Saccharomyces cerevisiae
gggattcttg

SEQ ID NO: 4569 - DNA, 10 bp, Saccharomyces cerevisiae
gggccaaccc

SEQ ID NO: 4570 - DNA, 10 bp, Saccharomyces cerevisiae
gggccagctt

SEQ ID NO: 4571 - DNA, 10 bp, Saccharomyces cerevisiae
gggctctgaa

SEQ ID NO: 4572 - DNA, 10 bp, Saccharomyces cerevisiae
ggggtgctag

SEQ ID NO: 4573 - DNA, 10 bp, Saccharomyces cerevisiae
ggggttaacg

SEQ ID NO: 4574 - DNA, 10 bp, Saccharomyces cerevisiae
gggtggtatt

SEQ ID NO: 4575 - DNA, 10 bp, Saccharomyces cerevisiae
gggtgttacc

SEQ ID NO: 4576 - DNA, 10 bp, Saccharomyces cerevisiae
gggttctcta

SEQ ID NO: 4577 - DNA, 10 bp, Saccharomyces cerevisiae
gggttgacaa

SEQ ID NO: 4578 - DNA, 10 bp, Saccharomyces cerevisiae
ggtaaaacaa

SEQ ID NO: 4579 - DNA, 10 bp, Saccharomyces cerevisiae
ggtaaatacc

SEQ ID NO: 4580 - DNA, 10 bp, Saccharomyces cerevisiae
ggtaactcca

SEQ ID NO: 4581 - DNA, 10 bp, Saccharomyces cerevisiae
ggtacgcaag

SEQ ID NO: 4582 - DNA, 10 bp, Saccharomyces cerevisiae
ggtcaagaat

SEQ ID NO: 4583 - DNA, 10 bp, Saccharomyces cerevisiae
ggtcactcct

SEQ ID NO: 4584 - DNA, 10 bp, Saccharomyces cerevisiae
ggtccagatg

SEQ ID NO: 4585 - DNA, 10 bp, Saccharomyces cerevisiae
ggtccagcct

SEQ ID NO: 4586 - DNA, 10 bp, Saccharomyces cerevisiae
ggtccagtta

SEQ ID NO: 4587 - DNA, 10 bp, Saccharomyces cerevisiae
ggtcctctct

SEQ ID NO: 4588 - DNA, 10 bp, Saccharomyces cerevisiae
ggtctcggtt

SEQ ID NO: 4589 - DNA, 10 bp, Saccharomyces cerevisiae
ggtgaagaag

SEQ ID NO: 4590 - DNA, 10 bp, Saccharomyces cerevisiae
ggtgaggatt

SEQ ID NO: 4591 - DNA, 10 bp, Saccharomyces cerevisiae
ggtgataacg

SEQ ID NO: 4592 - DNA, 10 bp, Saccharomyces cerevisiae
ggtgctaaca

SEQ ID NO: 4593 - DNA, 10 bp, Saccharomyces cerevisiae
ggtgctaagt

SEQ ID NO: 4594 - DNA, 10 bp, Saccharomyces cerevisiae
ggtgctgaga

SEQ ID NO: 4595 - DNA, 10 bp, Saccharomyces cerevisiae
ggtggtaacg

SEQ ID NO: 4596 - DNA, 10 bp, Saccharomyces cerevisiae
ggtgtacacg

SEQ ID NO: 4597 - DNA, 10 bp, Saccharomyces cerevisiae
ggtgtggact

SEQ ID NO: 4598 - DNA, 10 bp, Saccharomyces cerevisiae
ggtgttaaca

SEQ ID NO: 4599 - DNA, 10 bp, Saccharomyces cerevisiae
ggtgttcacg

SEQ ID NO: 4600 - DNA, 10 bp, Saccharomyces cerevisiae
ggtgtttaac

SEQ ID NO: 4601 - DNA, 10 bp, Saccharomyces cerevisiae
ggttaaacgt

SEQ ID NO: 4602 - DNA, 10 bp, Saccharomyces cerevisiae
ggttccacga

SEQ ID NO: 4603 - DNA, 10 bp, Saccharomyces cerevisiae
ggttcggtta

SEQ ID NO: 4604 - DNA, 10 bp, Saccharomyces cerevisiae
ggttctaatt

SEQ ID NO: 4605 - DNA, 10 bp, Saccharomyces cerevisiae
ggttctggtt

SEQ ID NO: 4606 - DNA, 10 bp, Saccharomyces cerevisiae
ggtttaggtt

SEQ ID NO: 4607 - DNA, 10 bp, Saccharomyces cerevisiae
ggtttgtatt

SEQ ID NO: 4608 - DNA, 10 bp, Saccharomyces cerevisiae
ggttttgatt

SEQ ID NO: 4609 - DNA, 10 bp, Saccharomyces cerevisiae
gtaaaaaaaa

SEQ ID NO: 4610 - DNA, 10 bp, Saccharomyces cerevisiae
gtaaagacct

SEQ ID NO: 4611 - DNA, 10 bp, Saccharomyces cerevisiae
gtaacgattg

SEQ ID NO: 4612 - DNA, 10 bp, Saccharomyces cerevisiae
gtaacgtaca

SEQ ID NO: 4613 - DNA, 10 bp, Saccharomyces cerevisiae
gtaactggac

SEQ ID NO: 4614 - DNA, 10 bp, Saccharomyces cerevisiae
gtaagaaata

SEQ ID NO: 4615 - DNA, 10 bp, Saccharomyces cerevisiae
gtaaggacgc

SEQ ID NO: 4616 - DNA, 10 bp, Saccharomyces cerevisiae
gtacaaaaaa

SEQ ID NO: 4617 - DNA, 10 bp, Saccharomyces cerevisiae
gtacaagcaa

SEQ ID NO: 4618 - DNA, 10 bp, Saccharomyces cerevisiae
gtacacctga

SEQ ID NO: 4619 - DNA, 10 bp, Saccharomyces cerevisiae
gtacacctgg

SEQ ID NO: 4620 - DNA, 10 bp, Saccharomyces cerevisiae
gtacagggct

SEQ ID NO: 4621 - DNA, 10 bp, Saccharomyces cerevisiae
gtaccaactc

SEQ ID NO: 4622 - DNA, 10 bp, Saccharomyces cerevisiae
gtacccgaaa

SEQ ID NO: 4623 - DNA, 10 bp, Saccharomyces cerevisiae
gtacccttat

SEQ ID NO: 4624 - DNA, 10 bp, Saccharomyces cerevisiae
gtacggttgt

SEQ ID NO: 4625 - DNA, 10 bp, Saccharomyces cerevisiae
gtactcctct

SEQ ID NO: 4626 - DNA, 10 bp, Saccharomyces cerevisiae
gtacttctag

SEQ ID NO: 4627 - DNA, 10 bp, Saccharomyces cerevisiae
gtacttgtac

SEQ ID NO: 4628 - DNA, 10 bp, Saccharomyces cerevisiae
gtactttcgg

SEQ ID NO: 4629 - DNA, 10 bp, Saccharomyces cerevisiae
gtagaacacc

SEQ ID NO: 4630 - DNA, 10 bp, Saccharomyces cerevisiae
gtagatagcg

SEQ ID NO: 4631 - DNA, 10 bp, Saccharomyces cerevisiae
gtagcgatcg

SEQ ID NO: 4632 - DNA, 10 bp, Saccharomyces cerevisiae
gtagcgggtg

SEQ ID NO: 4633 - DNA, 10 bp, Saccharomyces cerevisiae
gtagtttgtc

SEQ ID NO: 4634 - DNA, 10 bp, Saccharomyces cerevisiae
gtatatatgc

SEQ ID NO: 4635 - DNA, 10 bp, Saccharomyces cerevisiae
gtatggccac

SEQ ID NO: 4636 - DNA, 10 bp, Saccharomyces cerevisiae
gtattctagt

SEQ ID NO: 4637 - DNA, 10 bp, Saccharomyces cerevisiae
gtattgattt

SEQ ID NO: 4638 - DNA, 10 bp, Saccharomyces cerevisiae
gtcaaaaaaa

SEQ ID NO: 4639 - DNA, 10 bp, Saccharomyces cerevisiae
gtcaagcaat

SEQ ID NO: 4640 - DNA, 10 bp, Saccharomyces cerevisiae
gtcaatggct

SEQ ID NO: 4641 - DNA, 10 bp, Saccharomyces cerevisiae
gtcacgttgg

SEQ ID NO: 4642 - DNA, 10 bp, Saccharomyces cerevisiae
gtcactggta

SEQ ID NO: 4643 - DNA, 10 bp, Saccharomyces cerevisiae
gtcatatggt

SEQ ID NO: 4644 - DNA, 10 bp, Saccharomyces cerevisiae
gtcatcactt

SEQ ID NO: 4645 - DNA, 10 bp, Saccharomyces cerevisiae
gtccctgaaa

SEQ ID NO: 4646 - DNA, 10 bp, Saccharomyces cerevisiae
gtccctttag

SEQ ID NO: 4647 - DNA, 10 bp, Saccharomyces cerevisiae
gtcctccaga

SEQ ID NO: 4648 - DNA, 10 bp, Saccharomyces cerevisiae
gtcgccttta

SEQ ID NO: 4649 - DNA, 10 bp, Saccharomyces cerevisiae
gtcggtatgg

SEQ ID NO: 4650 - DNA, 10 bp, Saccharomyces cerevisiae
gtcgtcctac

SEQ ID NO: 4651 - DNA, 10 bp, Saccharomyces cerevisiae
gtcgtttatt

SEQ ID NO: 4652 - DNA, 10 bp, Saccharomyces cerevisiae
gtctattctt

SEQ ID NO: 4653 - DNA, 10 bp, Saccharomyces cerevisiae
gtctgcacct

SEQ ID NO: 4654 - DNA, 10 bp, Saccharomyces cerevisiae
gtgaaaatag

SEQ ID NO: 4655 - DNA, 10 bp, Saccharomyces cerevisiae
gtgaacaacg

SEQ ID NO: 4656 - DNA, 10 bp, Saccharomyces cerevisiae
gtgaacagtc

SEQ ID NO: 4657 - DNA, 10 bp, Saccharomyces cerevisiae
gtgaagctcg

SEQ ID NO: 4658 - DNA, 10 bp, Saccharomyces cerevisiae
gtgaaggcgc

SEQ ID NO: 4659 - DNA, 10 bp, Saccharomyces cerevisiae
gtgaaggttc

SEQ ID NO: 4660 - DNA, 10 bp, Saccharomyces cerevisiae
gtgacaacgt

SEQ ID NO: 4661 - DNA, 10 bp, Saccharomyces cerevisiae
gtgacagatg

SEQ ID NO: 4662 - DNA, 10 bp, Saccharomyces cerevisiae
gtgacgctct

SEQ ID NO: 4663 - DNA, 10 bp, Saccharomyces cerevisiae
gtgataaagc

SEQ ID NO: 4664 - DNA, 10 bp, Saccharomyces cerevisiae
gtgataccag

SEQ ID NO: 4665 - DNA, 10 bp, Saccharomyces cerevisiae
gtgatatcag

SEQ ID NO: 4666 - DNA, 10 bp, Saccharomyces cerevisiae
gtgatgatga

SEQ ID NO: 4667 - DNA, 10 bp, Saccharomyces cerevisiae
gtgattaggc

SEQ ID NO: 4668 - DNA, 10 bp, Saccharomyces cerevisiae
gtgatttgac

SEQ ID NO: 4669 - DNA, 10 bp, Saccharomyces cerevisiae
gtgctcaaaa

SEQ ID NO: 4670 - DNA, 10 bp, Saccharomyces cerevisiae
gtgctgcata

SEQ ID NO: 4671 - DNA, 10 bp, Saccharomyces cerevisiae
gtggaacata

SEQ ID NO: 4672 - DNA, 10 bp, Saccharomyces cerevisiae
gtggagccgg

SEQ ID NO: 4673 - DNA, 10 bp, Saccharomyces cerevisiae
gtggattctt

SEQ ID NO: 4674 - DNA, 10 bp, Saccharomyces cerevisiae
gtggcggaca

SEQ ID NO: 4675 - DNA, 10 bp, Saccharomyces cerevisiae
gtgggacaaa

SEQ ID NO: 4676 - DNA, 10 bp, Saccharomyces cerevisiae
gtgggctgct

SEQ ID NO: 4677 - DNA, 10 bp, Saccharomyces cerevisiae
gtgggtattg

SEQ ID NO: 4678 - DNA, 10 bp, Saccharomyces cerevisiae
gtggtccttt

SEQ ID NO: 4679 - DNA, 10 bp, Saccharomyces cerevisiae
gtggttcaat

SEQ ID NO: 4680 - DNA, 10 bp, Saccharomyces cerevisiae
gtgtcattgg

SEQ ID NO: 4681 - DNA, 10 bp, Saccharomyces cerevisiae
gtgtgttcta

SEQ ID NO: 4682 - DNA, 10 bp, Saccharomyces cerevisiae
gtgttcttac

SEQ ID NO: 4683 - DNA, 10 bp, Saccharomyces cerevisiae
gtgttgaaaa

SEQ ID NO: 4684 - DNA, 10 bp, Saccharomyces cerevisiae
gtgttgagaa

SEQ ID NO: 4685 - DNA, 10 bp, Saccharomyces cerevisiae
gtgttggtgc

SEQ ID NO: 4686 - DNA, 10 bp, Saccharomyces cerevisiae
gttaacgata

SEQ ID NO: 4687 - DNA, 10 bp, Saccharomyces cerevisiae
gttaagccaa

SEQ ID NO: 4688 - DNA, 10 bp, Saccharomyces cerevisiae
gttaatgatg

SEQ ID NO: 4689 - DNA, 10 bp, Saccharomyces cerevisiae
gttacaagaa

SEQ ID NO: 4690 - DNA, 10 bp, Saccharomyces cerevisiae
gttacatccg

SEQ ID NO: 4691 - DNA, 10 bp, Saccharomyces cerevisiae
gttacctacc

SEQ ID NO: 4692 - DNA, 10 bp, Saccharomyces cerevisiae
gttacggcca

SEQ ID NO: 4693 - DNA, 10 bp, Saccharomyces cerevisiae
gttagaagag

SEQ ID NO: 4694 - DNA, 10 bp, Saccharomyces cerevisiae
gttagatccc

SEQ ID NO: 4695 - DNA, 10 bp, Saccharomyces cerevisiae
gttatcagtg

SEQ ID NO: 4696 - DNA, 10 bp, Saccharomyces cerevisiae
gttatggtca

SEQ ID NO: 4697 - DNA, 10 bp, Saccharomyces cerevisiae
gttatgtatt

SEQ ID NO: 4698 - DNA, 10 bp, Saccharomyces cerevisiae
gttatttata

SEQ ID NO: 4699 - DNA, 10 bp, Saccharomyces cerevisiae
gttatttatc

SEQ ID NO: 4700 - DNA, 10 bp, Saccharomyces cerevisiae
gttcaaaaac

SEQ ID NO: 4701 - DNA, 10 bp, Saccharomyces cerevisiae
gttcaacggg

SEQ ID NO: 4702 - DNA, 10 bp, Saccharomyces cerevisiae
gttcaagaac

SEQ ID NO: 4703 - DNA, 10 bp, Saccharomyces cerevisiae
gttcccagac

SEQ ID NO: 4704 - DNA, 10 bp, Saccharomyces cerevisiae
gttcgggtca

SEQ ID NO: 4705 - DNA, 10 bp, Saccharomyces cerevisiae
gttctaaata

SEQ ID NO: 4706 - DNA, 10 bp, Saccharomyces cerevisiae
gttctctagc

SEQ ID NO: 4707 - DNA, 10 bp, Saccharomyces cerevisiae
gttctcttct

SEQ ID NO: 4708 - DNA, 10 bp, Saccharomyces cerevisiae
gttcttattt

SEQ ID NO: 4709 - DNA, 10 bp, Saccharomyces cerevisiae
gttgagattt

SEQ ID NO: 4710 - DNA, 10 bp, Saccharomyces cerevisiae
gttgatgcta

SEQ ID NO: 4711 - DNA, 10 bp, Saccharomyces cerevisiae
gttgcggtcc

SEQ ID NO: 4712 - DNA, 10 bp, Saccharomyces cerevisiae
gttggataaa

SEQ ID NO: 4713 - DNA, 10 bp, Saccharomyces cerevisiae
gttgtcttca

SEQ ID NO: 4714 - DNA, 10 bp, Saccharomyces cerevisiae
gttgtgagca

SEQ ID NO: 4715 - DNA, 10 bp, Saccharomyces cerevisiae
gttgtgggag

SEQ ID NO: 4716 - DNA, 10 bp, Saccharomyces cerevisiae
gttgttaccg

SEQ ID NO: 4717 - DNA, 10 bp, Saccharomyces cerevisiae
gtttaaaaaa

SEQ ID NO: 4718 - DNA, 10 bp, Saccharomyces cerevisiae
gtttacaaaa

SEQ ID NO: 4719 - DNA, 10 bp, Saccharomyces cerevisiae
gtttacccaa

SEQ ID NO: 4720 - DNA, 10 bp, Saccharomyces cerevisiae
gtttcagcgg

SEQ ID NO: 4721 - DNA, 10 bp, Saccharomyces cerevisiae
gtttccaaaa

SEQ ID NO: 4722 - DNA, 10 bp, Saccharomyces cerevisiae
gtttcctttt

SEQ ID NO: 4723 - DNA, 10 bp, Saccharomyces cerevisiae
gtttgaaaaa

SEQ ID NO: 4724 - DNA, 10 bp, Saccharomyces cerevisiae
gtttgaccta

SEQ ID NO: 4725 - DNA, 10 bp, Saccharomyces cerevisiae
gtttgattac

SEQ ID NO: 4726 - DNA, 10 bp, Saccharomyces cerevisiae
gtttgcaatc

SEQ ID NO: 4727 - DNA, 10 bp, Saccharomyces cerevisiae
gtttgtagac

SEQ ID NO: 4728 - DNA, 10 bp, Saccharomyces cerevisiae
gtttgtgaac

SEQ ID NO: 4729 - DNA, 10 bp, Saccharomyces cerevisiae
gttttcacca

SEQ ID NO: 4730 - DNA, 10 bp, Saccharomyces cerevisiae
gttttcattg

SEQ ID NO: 4731 - DNA, 10 bp, Saccharomyces cerevisiae
gttttcttcc

SEQ ID NO: 4732 - DNA, 10 bp, Saccharomyces cerevisiae
gttttctttc

SEQ ID NO: 4733 - DNA, 10 bp, Saccharomyces cerevisiae
taaagtccag

SEQ ID NO: 4734 - DNA, 10 bp, Saccharomyces cerevisiae
taaataaaaa

SEQ ID NO: 4735 - DNA, 10 bp, Saccharomyces cerevisiae
taaataagat

SEQ ID NO: 4736 - DNA, 10 bp, Saccharomyces cerevisiae
taaataataa

SEQ ID NO: 4737 - DNA, 10 bp, Saccharomyces cerevisiae
taaatataaa

SEQ ID NO: 4738 - DNA, 10 bp, Saccharomyces cerevisiae
taaatatgtt

SEQ ID NO: 4739 - DNA, 10 bp, Saccharomyces cerevisiae
taaatcagta

SEQ ID NO: 4740 - DNA, 10 bp, Saccharomyces cerevisiae
taaatggtct

SEQ ID NO: 4741 - DNA, 10 bp, Saccharomyces cerevisiae
taaattttac

SEQ ID NO: 4742 - DNA, 10 bp, Saccharomyces cerevisiae
taacaaagag

SEQ ID NO: 4743 - DNA, 10 bp, Saccharomyces cerevisiae
taacaactta

SEQ ID NO: 4744 - DNA, 10 bp, Saccharomyces cerevisiae
taactaagac

SEQ ID NO: 4745 - DNA, 10 bp, Saccharomyces cerevisiae
taacttcgtt

SEQ ID NO: 4746 - DNA, 10 bp, Saccharomyces cerevisiae
taagcagatt

SEQ ID NO: 4747 - DNA, 10 bp, Saccharomyces cerevisiae
taagcttttt

SEQ ID NO: 4748 - DNA, 10 bp, Saccharomyces cerevisiae
taatctttga

SEQ ID NO: 4749 - DNA, 10 bp, Saccharomyces cerevisiae
taatgctaaa

SEQ ID NO: 4750 - DNA, 10 bp, Saccharomyces cerevisiae
taatgctaac

SEQ ID NO: 4751 - DNA, 10 bp, Saccharomyces cerevisiae
taattgaaaa

SEQ ID NO: 4752 - DNA, 10 bp, Saccharomyces cerevisiae
taattgatag

SEQ ID NO: 4753 - DNA, 10 bp, Saccharomyces cerevisiae
taattgtcgg

SEQ ID NO: 4754 - DNA, 10 bp, Saccharomyces cerevisiae
taatttacgc

SEQ ID NO: 4755 - DNA, 10 bp, Saccharomyces cerevisiae
taatttagat

SEQ ID NO: 4756 - DNA, 10 bp, Saccharomyces cerevisiae
taattttcat

SEQ ID NO: 4757 - DNA, 10 bp, Saccharomyces cerevisiae
taatttttga

SEQ ID NO: 4758 - DNA, 10 bp, Saccharomyces cerevisiae
tacaaaaaaa

SEQ ID NO: 4759 - DNA, 10 bp, Saccharomyces cerevisiae
tacaacaatt

SEQ ID NO: 4760 - DNA, 10 bp, Saccharomyces cerevisiae
tacaatatat

SEQ ID NO: 4761 - DNA, 10 bp, Saccharomyces cerevisiae
tacaatctta

SEQ ID NO: 4762 - DNA, 10 bp, Saccharomyces cerevisiae
tacacaagtg

SEQ ID NO: 4763 - DNA, 10 bp, Saccharomyces cerevisiae
tacacccagc

SEQ ID NO: 4764 - DNA, 10 bp, Saccharomyces cerevisiae
tacacgcgcg

SEQ ID NO: 4765 - DNA, 10 bp, Saccharomyces cerevisiae
tacagctgtg

SEQ ID NO: 4766 - DNA, 10 bp, Saccharomyces cerevisiae
tacatacctg

SEQ ID NO: 4767 - DNA, 10 bp, Saccharomyces cerevisiae
tacattctaa

SEQ ID NO: 4768 - DNA, 10 bp, Saccharomyces cerevisiae
tacatttgct

SEQ ID NO: 4769 - DNA, 10 bp, Saccharomyces cerevisiae
taccaactct

SEQ ID NO: 4770 - DNA, 10 bp, Saccharomyces cerevisiae
taccacccct

SEQ ID NO: 4771 - DNA, 10 bp, Saccharomyces cerevisiae
taccactccg

SEQ ID NO: 4772 - DNA, 10 bp, Saccharomyces cerevisiae
taccagcaaa

SEQ ID NO: 4773 - DNA, 10 bp, Saccharomyces cerevisiae
tacccgtaag

SEQ ID NO: 4774 - DNA, 10 bp, Saccharomyces cerevisiae
tacctcgtta

SEQ ID NO: 4775 - DNA, 10 bp, Saccharomyces cerevisiae
taccttaggt

SEQ ID NO: 4776 - DNA, 10 bp, Saccharomyces cerevisiae
taccttctct

SEQ ID NO: 4777 - DNA, 10 bp, Saccharomyces cerevisiae
tacgaggaca

SEQ ID NO: 4778 - DNA, 10 bp, Saccharomyces cerevisiae
tacgaggcaa

SEQ ID NO: 4779 - DNA, 10 bp, Saccharomyces cerevisiae
tacgctaata

SEQ ID NO: 4780 - DNA, 10 bp, Saccharomyces cerevisiae
tacgtctcca

SEQ ID NO: 4781 - DNA, 10 bp, Saccharomyces cerevisiae
tacgttgccg

SEQ ID NO: 4782 - DNA, 10 bp, Saccharomyces cerevisiae
tactactcct

SEQ ID NO: 4783 - DNA, 10 bp, Saccharomyces cerevisiae
tactatacac

SEQ ID NO: 4784 - DNA, 10 bp, Saccharomyces cerevisiae
tactatgcta

SEQ ID NO: 4785 - DNA, 10 bp, Saccharomyces cerevisiae
tactctcgct

SEQ ID NO: 4786 - DNA, 10 bp, Saccharomyces cerevisiae
tactctcgtt

SEQ ID NO: 4787 - DNA, 10 bp, Saccharomyces cerevisiae
tactggttta

SEQ ID NO: 4788 - DNA, 10 bp, Saccharomyces cerevisiae
tacttataaa

SEQ ID NO: 4789 - DNA, 10 bp, Saccharomyces cerevisiae
tacttgttgg

SEQ ID NO: 4790 - DNA, 10 bp, Saccharomyces cerevisiae
tactttaaac

SEQ ID NO: 4791 - DNA, 10 bp, Saccharomyces cerevisiae
tactttatct

SEQ ID NO: 4792 - DNA, 10 bp, Saccharomyces cerevisiae
tactttggaa

SEQ ID NO: 4793 - DNA, 10 bp, Saccharomyces cerevisiae
tagaaatgcg

SEQ ID NO: 4794 - DNA, 10 bp, Saccharomyces cerevisiae
tagaagaaaa

SEQ ID NO: 4795 - DNA, 10 bp, Saccharomyces cerevisiae
tagattggca

SEQ ID NO: 4796 - DNA, 10 bp, Saccharomyces cerevisiae
tagatttcat

SEQ ID NO: 4797 - DNA, 10 bp, Saccharomyces cerevisiae
tagcaaaagg

SEQ ID NO: 4798 - DNA, 10 bp, Saccharomyces cerevisiae
tagcaacggg

SEQ ID NO: 4799 - DNA, 10 bp, Saccharomyces cerevisiae
tagcaccgcc

SEQ ID NO: 4800 - DNA, 10 bp, Saccharomyces cerevisiae
tagcactatt

SEQ ID NO: 4801 - DNA, 10 bp, Saccharomyces cerevisiae
tagcataaac

SEQ ID NO: 4802 - DNA, 10 bp, Saccharomyces cerevisiae
tagccaattt

SEQ ID NO: 4803 - DNA, 10 bp, Saccharomyces cerevisiae
tagccatacc

SEQ ID NO: 4804 - DNA, 10 bp, Saccharomyces cerevisiae
tagctgccca

SEQ ID NO: 4805 - DNA, 10 bp, Saccharomyces cerevisiae
tagctttttc

SEQ ID NO: 4806 - DNA, 10 bp, Saccharomyces cerevisiae
taggaagaaa

SEQ ID NO: 4807 - DNA, 10 bp, Saccharomyces cerevisiae
taggcaccaa

SEQ ID NO: 4808 - DNA, 10 bp, Saccharomyces cerevisiae
taggcagtga

SEQ ID NO: 4809 - DNA, 10 bp, Saccharomyces cerevisiae
tagtagtaac

SEQ ID NO: 4810 - DNA, 10 bp, Saccharomyces cerevisiae
tagtcgctgt

SEQ ID NO: 4811 - DNA, 10 bp, Saccharomyces cerevisiae
tagtcggaga

SEQ ID NO: 4812 - DNA, 10 bp, Saccharomyces cerevisiae
tagtgcgctg

SEQ ID NO: 4813 - DNA, 10 bp, Saccharomyces cerevisiae
tagtgctaag

SEQ ID NO: 4814 - DNA, 10 bp, Saccharomyces cerevisiae
tagttaatag

SEQ ID NO: 4815 - DNA, 10 bp, Saccharomyces cerevisiae
tagttcgtat

SEQ ID NO: 4816 - DNA, 10 bp, Saccharomyces cerevisiae
tagtttaggt

SEQ ID NO: 4817 - DNA, 10 bp, Saccharomyces cerevisiae
tagttttcta

SEQ ID NO: 4818 - DNA, 10 bp, Saccharomyces cerevisiae
tataaagaac

SEQ ID NO: 4819 - DNA, 10 bp, Saccharomyces cerevisiae
tataaatact

SEQ ID NO: 4820 - DNA, 10 bp, Saccharomyces cerevisiae
tataacccta

SEQ ID NO: 4821 - DNA, 10 bp, Saccharomyces cerevisiae
tataagtata

SEQ ID NO: 4822 - DNA, 10 bp, Saccharomyces cerevisiae
tataatagta

SEQ ID NO: 4823 - DNA, 10 bp, Saccharomyces cerevisiae
tataattgcg

SEQ ID NO: 4824 - DNA, 10 bp, Saccharomyces cerevisiae
tatacatagt

SEQ ID NO: 4825 - DNA, 10 bp, Saccharomyces cerevisiae
tatacttagc

SEQ ID NO: 4826 - DNA, 10 bp, Saccharomyces cerevisiae
tatagagaac

SEQ ID NO: 4827 - DNA, 10 bp, Saccharomyces cerevisiae
tatagattgt

SEQ ID NO: 4828 - DNA, 10 bp, Saccharomyces cerevisiae
tatatcttaa

SEQ ID NO: 4829 - DNA, 10 bp, Saccharomyces cerevisiae
tatatcttcc

SEQ ID NO: 4830 - DNA, 10 bp, Saccharomyces cerevisiae
tatatttaaa

SEQ ID NO: 4831 - DNA, 10 bp, Saccharomyces cerevisiae
tatcaaactt

SEQ ID NO: 4832 - DNA, 10 bp, Saccharomyces cerevisiae
tatcagacga

SEQ ID NO: 4833 - DNA, 10 bp, Saccharomyces cerevisiae
tatccagttg

SEQ ID NO: 4834 - DNA, 10 bp, Saccharomyces cerevisiae
tatccatcaa

SEQ ID NO: 4835 - DNA, 10 bp, Saccharomyces cerevisiae
tatcctcaca

SEQ ID NO: 4836 - DNA, 10 bp, Saccharomyces cerevisiae
tatctacgta

SEQ ID NO: 4837 - DNA, 10 bp, Saccharomyces cerevisiae
tatgacggga

SEQ ID NO: 4838 - DNA, 10 bp, Saccharomyces cerevisiae
tatgcgttga

SEQ ID NO: 4839 - DNA, 10 bp, Saccharomyces cerevisiae
tatggctcct

SEQ ID NO: 4840 - DNA, 10 bp, Saccharomyces cerevisiae
tatgggcgaa

SEQ ID NO: 4841 - DNA, 10 bp, Saccharomyces cerevisiae
tatgtaatac

SEQ ID NO: 4842 - DNA, 10 bp, Saccharomyces cerevisiae
tatgtatata

SEQ ID NO: 4843 - DNA, 10 bp, Saccharomyces cerevisiae
tattagcgtg

SEQ ID NO: 4844 - DNA, 10 bp, Saccharomyces cerevisiae
tattatactt

SEQ ID NO: 4845 - DNA, 10 bp, Saccharomyces cerevisiae
tattcattta

SEQ ID NO: 4846 - DNA, 10 bp, Saccharomyces cerevisiae
tattccccaa

SEQ ID NO: 4847 - DNA, 10 bp, Saccharomyces cerevisiae
tattctttac

SEQ ID NO: 4848 - DNA, 10 bp, Saccharomyces cerevisiae
tattggactc

SEQ ID NO: 4849 - DNA, 10 bp, Saccharomyces cerevisiae
tatttaattg

SEQ ID NO: 4850 - DNA, 10 bp, Saccharomyces cerevisiae
tatttaccat

SEQ ID NO: 4851 - DNA, 10 bp, Saccharomyces cerevisiae
tatttattac

SEQ ID NO: 4852 - DNA, 10 bp, Saccharomyces cerevisiae
tatttattcc

SEQ ID NO: 4853 - DNA, 10 bp, Saccharomyces cerevisiae
tatttcttat

SEQ ID NO: 4854 - DNA, 10 bp, Saccharomyces cerevisiae
tatttcttgt

SEQ ID NO: 4855 - DNA, 10 bp, Saccharomyces cerevisiae
tatttggcac

SEQ ID NO: 4856 - DNA, 10 bp, Saccharomyces cerevisiae
tcaaaaagtc

SEQ ID NO: 4857 - DNA, 10 bp, Saccharomyces cerevisiae
tcaaaggtgc

SEQ ID NO: 4858 - DNA, 10 bp, Saccharomyces cerevisiae
tcaaatatga

SEQ ID NO: 4859 - DNA, 10 bp, Saccharomyces cerevisiae
tcaagaaatg

SEQ ID NO: 4860 - DNA, 10 bp, Saccharomyces cerevisiae
tcaaggcata

SEQ ID NO: 4861 - DNA, 10 bp, Saccharomyces cerevisiae
tcaagtactc

SEQ ID NO: 4862 - DNA, 10 bp, Saccharomyces cerevisiae
tcaagttggg

SEQ ID NO: 4863 - DNA, 10 bp, Saccharomyces cerevisiae
tcaatatcac

SEQ ID NO: 4864 - DNA, 10 bp, Saccharomyces cerevisiae
tcaattacat

SEQ ID NO: 4865 - DNA, 10 bp, Saccharomyces cerevisiae
tcacagaatc

SEQ ID NO: 4866 - DNA, 10 bp, Saccharomyces cerevisiae
tcaccagaag

SEQ ID NO: 4867 - DNA, 10 bp, Saccharomyces cerevisiae
tcacccacac

SEQ ID NO: 4868 - DNA, 10 bp, Saccharomyces cerevisiae
tcagagtcaa

SEQ ID NO: 4869 - DNA, 10 bp, Saccharomyces cerevisiae
tcagcattct

SEQ ID NO: 4870 - DNA, 10 bp, Saccharomyces cerevisiae
tcagccaaga

SEQ ID NO: 4871 - DNA, 10 bp, Saccharomyces cerevisiae
tcagctcaag

SEQ ID NO: 4872 - DNA, 10 bp, Saccharomyces cerevisiae
tcagtttcta

SEQ ID NO: 4873 - DNA, 10 bp, Saccharomyces cerevisiae
tcatatttcc

SEQ ID NO: 4874 - DNA, 10 bp, Saccharomyces cerevisiae
tcatcatcag

SEQ ID NO: 4875 - DNA, 10 bp, Saccharomyces cerevisiae
tcattgaacg

SEQ ID NO: 4876 - DNA, 10 bp, Saccharomyces cerevisiae
tcattgattc

SEQ ID NO: 4877 - DNA, 10 bp, Saccharomyces cerevisiae
tcatttatga

SEQ ID NO: 4878 - DNA, 10 bp, Saccharomyces cerevisiae
tccaaaatca

SEQ ID NO: 4879 - DNA, 10 bp, Saccharomyces cerevisiae
tccaaattac

SEQ ID NO: 4880 - DNA, 10 bp, Saccharomyces cerevisiae
tccacacaca

SEQ ID NO: 4881 - DNA, 10 bp, Saccharomyces cerevisiae
tccactcctt

SEQ ID NO: 4882 - DNA, 10 bp, Saccharomyces cerevisiae
tccatatata

SEQ ID NO: 4883 - DNA, 10 bp, Saccharomyces cerevisiae
tccatctgta

SEQ ID NO: 4884 - DNA, 10 bp, Saccharomyces cerevisiae
tcccaattaa

SEQ ID NO: 4885 - DNA, 10 bp, Saccharomyces cerevisiae
tccccggtac

SEQ ID NO: 4886 - DNA, 10 bp, Saccharomyces cerevisiae
tccccgtcat

SEQ ID NO: 4887 - DNA, 10 bp, Saccharomyces cerevisiae
tccccgtcca

SEQ ID NO: 4888 - DNA, 10 bp, Saccharomyces cerevisiae
tccctacgcc

SEQ ID NO: 4889 - DNA, 10 bp, Saccharomyces cerevisiae
tccctgtaca

SEQ ID NO: 4890 - DNA, 10 bp, Saccharomyces cerevisiae
tcccttatta

SEQ ID NO: 4891 - DNA, 10 bp, Saccharomyces cerevisiae
tccgagctgc

SEQ ID NO: 4892 - DNA, 10 bp, Saccharomyces cerevisiae
tccgttcact

SEQ ID NO: 4893 - DNA, 10 bp, Saccharomyces cerevisiae
tcctaagatg

SEQ ID NO: 4894 - DNA, 10 bp, Saccharomyces cerevisiae
tcctcaatta

SEQ ID NO: 4895 - DNA, 10 bp, Saccharomyces cerevisiae
tcctcgtaca

SEQ ID NO: 4896 - DNA, 10 bp, Saccharomyces cerevisiae
tcctctcgtt

SEQ ID NO: 4897 - DNA, 10 bp, Saccharomyces cerevisiae
tcctcttttc

SEQ ID NO: 4898 - DNA, 10 bp, Saccharomyces cerevisiae
tccttccagg

SEQ ID NO: 4899 - DNA, 10 bp, Saccharomyces cerevisiae
tccttgaatg

SEQ ID NO: 4900 - DNA, 10 bp, Saccharomyces cerevisiae
tccttggaag

SEQ ID NO: 4901 - DNA, 10 bp, Saccharomyces cerevisiae
tccttgtctg

SEQ ID NO: 4902 - DNA, 10 bp, Saccharomyces cerevisiae
tcgaacctct

SEQ ID NO: 4903 - DNA, 10 bp, Saccharomyces cerevisiae
tcgaactttt

SEQ ID NO: 4904 - DNA, 10 bp, Saccharomyces cerevisiae
tcgaagtcgt

SEQ ID NO: 4905 - DNA, 10 bp, Saccharomyces cerevisiae
tcgacaaccc

SEQ ID NO: 4906 - DNA, 10 bp, Saccharomyces cerevisiae
tcgactggaa

SEQ ID NO: 4907 - DNA, 10 bp, Saccharomyces cerevisiae
tcgagtcgaa

SEQ ID NO: 4908 - DNA, 10 bp, Saccharomyces cerevisiae
tcgatttatt

SEQ ID NO: 4909 - DNA, 10 bp, Saccharomyces cerevisiae
tcgccagaag

SEQ ID NO: 4910 - DNA, 10 bp, Saccharomyces cerevisiae
tcgccagtct

SEQ ID NO: 4911 - DNA, 10 bp, Saccharomyces cerevisiae
tcgcgcaatc

SEQ ID NO: 4912 - DNA, 10 bp, Saccharomyces cerevisiae
tcgctgtttt

SEQ ID NO: 4913 - DNA, 10 bp, Saccharomyces cerevisiae
tcgcttccag

SEQ ID NO: 4914 - DNA, 10 bp, Saccharomyces cerevisiae
tcggggagag

SEQ ID NO: 4915 - DNA, 10 bp, Saccharomyces cerevisiae
tcggtcaaat

SEQ ID NO: 4916 - DNA, 10 bp, Saccharomyces cerevisiae
tcggtcttat

SEQ ID NO: 4917 - DNA, 10 bp, Saccharomyces cerevisiae
tcggtggacc

SEQ ID NO: 4918 - DNA, 10 bp, Saccharomyces cerevisiae
tcgtcagaga

SEQ ID NO: 4919 - DNA, 10 bp, Saccharomyces cerevisiae
tcgtctgttc

SEQ ID NO: 4920 - DNA, 10 bp, Saccharomyces cerevisiae
tcgtgattac

SEQ ID NO: 4921 - DNA, 10 bp, Saccharomyces cerevisiae
tcgtgggagc

SEQ ID NO: 4922 - DNA, 10 bp, Saccharomyces cerevisiae
tcgttcactt

SEQ ID NO: 4923 - DNA, 10 bp, Saccharomyces cerevisiae
tctacgttcc

SEQ ID NO: 4924 - DNA, 10 bp, Saccharomyces cerevisiae
tctagctctt

SEQ ID NO: 4925 - DNA, 10 bp, Saccharomyces cerevisiae
tctcaaaaaa

SEQ ID NO: 4926 - DNA, 10 bp, Saccharomyces cerevisiae
tctccagttg

SEQ ID NO: 4927 - DNA, 10 bp, Saccharomyces cerevisiae
tctccggaag

SEQ ID NO: 4928 - DNA, 10 bp, Saccharomyces cerevisiae
tctccgtaca

SEQ ID NO: 4929 - DNA, 10 bp, Saccharomyces cerevisiae
tctcggttaa

SEQ ID NO: 4930 - DNA, 10 bp, Saccharomyces cerevisiae
tctctattgg

SEQ ID NO: 4931 - DNA, 10 bp, Saccharomyces cerevisiae
tctgaatata

SEQ ID NO: 4932 - DNA, 10 bp, Saccharomyces cerevisiae
tctgacttag

SEQ ID NO: 4933 - DNA, 10 bp, Saccharomyces cerevisiae
tctgcgtccg

SEQ ID NO: 4934 - DNA, 10 bp, Saccharomyces cerevisiae
tctggtttta

SEQ ID NO: 4935 - DNA, 10 bp, Saccharomyces cerevisiae
tctgtacaat

SEQ ID NO: 4936 - DNA, 10 bp, Saccharomyces cerevisiae
tctgttagaa

SEQ ID NO: 4937 - DNA, 10 bp, Saccharomyces cerevisiae
tcttcagaca

SEQ ID NO: 4938 - DNA, 10 bp, Saccharomyces cerevisiae
tcttcagctg

SEQ ID NO: 4939 - DNA, 10 bp, Saccharomyces cerevisiae
tcttccaacg

SEQ ID NO: 4940 - DNA, 10 bp, Saccharomyces cerevisiae
tcttccaaga

SEQ ID NO: 4941 - DNA, 10 bp, Saccharomyces cerevisiae
tcttggataa

SEQ ID NO: 4942 - DNA, 10 bp, Saccharomyces cerevisiae
tctttctggg

SEQ ID NO: 4943 - DNA, 10 bp, Saccharomyces cerevisiae
tctttttaca

SEQ ID NO: 4944 - DNA, 10 bp, Saccharomyces cerevisiae
tgaaagcttc

SEQ ID NO: 4945 - DNA, 10 bp, Saccharomyces cerevisiae
tgaaattcta

SEQ ID NO: 4946 - DNA, 10 bp, Saccharomyces cerevisiae
tgaactattt

SEQ ID NO: 4947 - DNA, 10 bp, Saccharomyces cerevisiae
tgaagaaaat

SEQ ID NO: 4948 - DNA, 10 bp, Saccharomyces cerevisiae
tgaattcttt

SEQ ID NO: 4949 - DNA, 10 bp, Saccharomyces cerevisiae
tgagggctta

SEQ ID NO: 4950 - DNA, 10 bp, Saccharomyces cerevisiae
tgatgagaag

SEQ ID NO: 4951 - DNA, 10 bp, Saccharomyces cerevisiae
tgattaatat

SEQ ID NO: 4952 - DNA, 10 bp, Saccharomyces cerevisiae
tgattgcaca

SEQ ID NO: 4953 - DNA, 10 bp, Saccharomyces cerevisiae
tgatttatcc

SEQ ID NO: 4954 - DNA, 10 bp, Saccharomyces cerevisiae
tgatttgtat

SEQ ID NO: 4955 - DNA, 10 bp, Saccharomyces cerevisiae
tgcaatcggc

SEQ ID NO: 4956 - DNA, 10 bp, Saccharomyces cerevisiae
tgcagaaagg

SEQ ID NO: 4957 - DNA, 10 bp, Saccharomyces cerevisiae
tgcagcgagt

SEQ ID NO: 4958 - DNA, 10 bp, Saccharomyces cerevisiae
tgcaggtgcc

SEQ ID NO: 4959 - DNA, 10 bp, Saccharomyces cerevisiae
tgcaggttgc

SEQ ID NO: 4960 - DNA, 10 bp, Saccharomyces cerevisiae
tgcagtggaa

SEQ ID NO: 4961 - DNA, 10 bp, Saccharomyces cerevisiae
tgcatcaaaa

SEQ ID NO: 4962 - DNA, 10 bp, Saccharomyces cerevisiae
tgccaggaaa

SEQ ID NO: 4963 - DNA, 10 bp, Saccharomyces cerevisiae
tgccttccgt

SEQ ID NO: 4964 - DNA, 10 bp, Saccharomyces cerevisiae
tgcgcaagtc

SEQ ID NO: 4965 - DNA, 10 bp, Saccharomyces cerevisiae
tgctaaacgc

SEQ ID NO: 4966 - DNA, 10 bp, Saccharomyces cerevisiae
tgctgttaca

SEQ ID NO: 4967 - DNA, 10 bp, Saccharomyces cerevisiae
tggacaatgt

SEQ ID NO: 4968 - DNA, 10 bp, Saccharomyces cerevisiae
tggacatcct

SEQ ID NO: 4969 - DNA, 10 bp, Saccharomyces cerevisiae
tggacatcta

SEQ ID NO: 4970 - DNA, 10 bp, Saccharomyces cerevisiae
tggacgaata

SEQ ID NO: 4971 - DNA, 10 bp, Saccharomyces cerevisiae
tggatactca

SEQ ID NO: 4972 - DNA, 10 bp, Saccharomyces cerevisiae
tggcggggca

SEQ ID NO: 4973 - DNA, 10 bp, Saccharomyces cerevisiae
tgggacacta

SEQ ID NO: 4974 - DNA, 10 bp, Saccharomyces cerevisiae
tgggagaagc

SEQ ID NO: 4975 - DNA, 10 bp, Saccharomyces cerevisiae
tgggtgtaga

SEQ ID NO: 4976 - DNA, 10 bp, Saccharomyces cerevisiae
tggtaacaga

SEQ ID NO: 4977 - DNA, 10 bp, Saccharomyces cerevisiae
tggtaattat

SEQ ID NO: 4978 - DNA, 10 bp, Saccharomyces cerevisiae
tggtcagtat

SEQ ID NO: 4979 - DNA, 10 bp, Saccharomyces cerevisiae
tggtcctccc

SEQ ID NO: 4980 - DNA, 10 bp, Saccharomyces cerevisiae
tggtcggagt

SEQ ID NO: 4981 - DNA, 10 bp, Saccharomyces cerevisiae
tggttctgct

SEQ ID NO: 4982 - DNA, 10 bp, Saccharomyces cerevisiae
tggtttattt

SEQ ID NO: 4983 - DNA, 10 bp, Saccharomyces cerevisiae
tgtaaaaaaa

SEQ ID NO: 4984 - DNA, 10 bp, Saccharomyces cerevisiae
tgtaaacgct

SEQ ID NO: 4985 - DNA, 10 bp, Saccharomyces cerevisiae
tgtaaattat

SEQ ID NO: 4986 - DNA, 10 bp, Saccharomyces cerevisiae
tgtaatttgg

SEQ ID NO: 4987 - DNA, 10 bp, Saccharomyces cerevisiae
tgtacgtggt

SEQ ID NO: 4988 - DNA, 10 bp, Saccharomyces cerevisiae
tgtagattat

SEQ ID NO: 4989 - DNA, 10 bp, Saccharomyces cerevisiae
tgtagcattt

SEQ ID NO: 4990 - DNA, 10 bp, Saccharomyces cerevisiae
tgtatcaata

SEQ ID NO: 4991 - DNA, 10 bp, Saccharomyces cerevisiae
tgtatccaac

SEQ ID NO: 4992 - DNA, 10 bp, Saccharomyces cerevisiae
tgtatttttg

SEQ ID NO: 4993 - DNA, 10 bp, Saccharomyces cerevisiae
tgtcagaaat

SEQ ID NO: 4994 - DNA, 10 bp, Saccharomyces cerevisiae
tgtcctcctc

SEQ ID NO: 4995 - DNA, 10 bp, Saccharomyces cerevisiae
tgtccttctc

SEQ ID NO: 4996 - DNA, 10 bp, Saccharomyces cerevisiae
tgtctcgtga

SEQ ID NO: 4997 - DNA, 10 bp, Saccharomyces cerevisiae
tgtggcttgt

SEQ ID NO: 4998 - DNA, 10 bp, Saccharomyces cerevisiae
tgtgttaacg

SEQ ID NO: 4999 - DNA, 10 bp, Saccharomyces cerevisiae
tgttaaacct

SEQ ID NO: 5000 - DNA, 10 bp, Saccharomyces cerevisiae
tgttcaaata

SEQ ID NO: 5001 - DNA, 10 bp, Saccharomyces cerevisiae
tgtttataag

SEQ ID NO: 5002 - DNA, 10 bp, Saccharomyces cerevisiae
tgttttagca

SEQ ID NO: 5003 - DNA, 10 bp, Saccharomyces cerevisiae
tgttttcatt

SEQ ID NO: 5004 - DNA, 10 bp, Saccharomyces cerevisiae
tgtttttaaa

SEQ ID NO: 5005 - DNA, 10 bp, Saccharomyces cerevisiae
tgtttttcac

SEQ ID NO: 5006 - DNA, 10 bp, Saccharomyces cerevisiae
ttaaaggtgc

SEQ ID NO: 5007 - DNA, 10 bp, Saccharomyces cerevisiae
ttaaatatat

SEQ ID NO: 5008 - DNA, 10 bp, Saccharomyces cerevisiae
ttaaatgttt

SEQ ID NO: 5009 - DNA, 10 bp, Saccharomyces cerevisiae
ttaatcgaag

SEQ ID NO: 5010 - DNA, 10 bp, Saccharomyces cerevisiae
ttaatgaagc

SEQ ID NO: 5011 - DNA, 10 bp, Saccharomyces cerevisiae
ttaatgcctg

SEQ ID NO: 5012 - DNA, 10 bp, Saccharomyces cerevisiae
ttaatgttat

SEQ ID NO: 5013 - DNA, 10 bp, Saccharomyces cerevisiae
ttaatgtttt

SEQ ID NO: 5014 - DNA, 10 bp, Saccharomyces cerevisiae
ttacagaagc

SEQ ID NO: 5015 - DNA, 10 bp, Saccharomyces cerevisiae
ttacagctca

SEQ ID NO: 5016 - DNA, 10 bp, Saccharomyces cerevisiae
ttaccgattt

SEQ ID NO: 5017 - DNA, 10 bp, Saccharomyces cerevisiae
ttacgatcat

SEQ ID NO: 5018 - DNA, 10 bp, Saccharomyces cerevisiae
ttactcaatt

SEQ ID NO: 5019 - DNA, 10 bp, Saccharomyces cerevisiae
ttacttcttt

SEQ ID NO: 5020 - DNA, 10 bp, Saccharomyces cerevisiae
ttagatgcaa

SEQ ID NO: 5021 - DNA, 10 bp, Saccharomyces cerevisiae
ttagggttgg

SEQ ID NO: 5022 - DNA, 10 bp, Saccharomyces cerevisiae
ttagtccaaa

SEQ ID NO: 5023 - DNA, 10 bp, Saccharomyces cerevisiae
ttagtgtcta

SEQ ID NO: 5024 - DNA, 10 bp, Saccharomyces cerevisiae
ttatgatagg

SEQ ID NO: 5025 - DNA, 10 bp, Saccharomyces cerevisiae
ttatgcttat

SEQ ID NO: 5026 - DNA, 10 bp, Saccharomyces cerevisiae
ttatggatgc

SEQ ID NO: 5027 - DNA, 10 bp, Saccharomyces cerevisiae
ttattatggg

SEQ ID NO: 5028 - DNA, 10 bp, Saccharomyces cerevisiae
ttattctggc

SEQ ID NO: 5029 - DNA, 10 bp, Saccharomyces cerevisiae
ttattgacgc

SEQ ID NO: 5030 - DNA, 10 bp, Saccharomyces cerevisiae
ttatttcaaa

SEQ ID NO: 5031 - DNA, 10 bp, Saccharomyces cerevisiae
ttattttttt

SEQ ID NO: 5032 - DNA, 10 bp, Saccharomyces cerevisiae
ttcaactaat

SEQ ID NO: 5033 - DNA, 10 bp, Saccharomyces cerevisiae
ttcacaattg

SEQ ID NO: 5034 - DNA, 10 bp, Saccharomyces cerevisiae
ttcaccggaa

SEQ ID NO: 5035 - DNA, 10 bp, Saccharomyces cerevisiae
ttcacctgtc

SEQ ID NO: 5036 - DNA, 10 bp, Saccharomyces cerevisiae
ttcagccaat

SEQ ID NO: 5037 - DNA, 10 bp, Saccharomyces cerevisiae
ttcagtgtaa

SEQ ID NO: 5038 - DNA, 10 bp, Saccharomyces cerevisiae
ttcatcaaca

SEQ ID NO: 5039 - DNA, 10 bp, Saccharomyces cerevisiae
ttcatcgcct

SEQ ID NO: 5040 - DNA, 10 bp, Saccharomyces cerevisiae
ttccaatggg

SEQ ID NO: 5041 - DNA, 10 bp, Saccharomyces cerevisiae
ttccacggac

SEQ ID NO: 5042 - DNA, 10 bp, Saccharomyces cerevisiae
ttcccgtaca

SEQ ID NO: 5043 - DNA, 10 bp, Saccharomyces cerevisiae
ttcctattaa

SEQ ID NO: 5044 - DNA, 10 bp, Saccharomyces cerevisiae
ttccttagct

SEQ ID NO: 5045 - DNA, 10 bp, Saccharomyces cerevisiae
ttccttgttt

SEQ ID NO: 5046 - DNA, 10 bp, Saccharomyces cerevisiae
ttcgacatat

SEQ ID NO: 5047 - DNA, 10 bp, Saccharomyces cerevisiae
ttcgccgctc

SEQ ID NO: 5048 - DNA, 10 bp, Saccharomyces cerevisiae
ttcgggtcag

SEQ ID NO: 5049 - DNA, 10 bp, Saccharomyces cerevisiae
ttcgtcactt

SEQ ID NO: 5050 - DNA, 10 bp, Saccharomyces cerevisiae
ttcgttcgct

SEQ ID NO: 5051 - DNA, 10 bp, Saccharomyces cerevisiae
ttctaatatt

SEQ ID NO: 5052 - DNA, 10 bp, Saccharomyces cerevisiae
ttctcaagtc

SEQ ID NO: 5053 - DNA, 10 bp, Saccharomyces cerevisiae
ttctgcatat

SEQ ID NO: 5054 - DNA, 10 bp, Saccharomyces cerevisiae
ttcttgttac

SEQ ID NO: 5055 - DNA, 10 bp, Saccharomyces cerevisiae
ttctttaatg

SEQ ID NO: 5056 - DNA, 10 bp, Saccharomyces cerevisiae
ttgaaagatt

SEQ ID NO: 5057 - DNA, 10 bp, Saccharomyces cerevisiae
ttgaaataag

SEQ ID NO: 5058 - DNA, 10 bp, Saccharomyces cerevisiae
ttgaacagct

SEQ ID NO: 5059 - DNA, 10 bp, Saccharomyces cerevisiae
ttgataatga

SEQ ID NO: 5060 - DNA, 10 bp, Saccharomyces cerevisiae
ttgatcaaca

SEQ ID NO: 5061 - DNA, 10 bp, Saccharomyces cerevisiae
ttgatgaaag

SEQ ID NO: 5062 - DNA, 10 bp, Saccharomyces cerevisiae
ttgattcaaa

SEQ ID NO: 5063 - DNA, 10 bp, Saccharomyces cerevisiae
ttgattgacc

SEQ ID NO: 5064 - DNA, 10 bp, Saccharomyces cerevisiae
ttgcaaggtg

SEQ ID NO: 5065 - DNA, 10 bp, Saccharomyces cerevisiae
ttgcacttct

SEQ ID NO: 5066 - DNA, 10 bp, Saccharomyces cerevisiae
ttgccagcct

SEQ ID NO: 5067 - DNA, 10 bp, Saccharomyces cerevisiae
ttgccagctt

SEQ ID NO: 5068 - DNA, 10 bp, Saccharomyces cerevisiae
ttgccagttt

SEQ ID NO: 5069 - DNA, 10 bp, Saccharomyces cerevisiae
ttgcctgtct

SEQ ID NO: 5070 - DNA, 10 bp, Saccharomyces cerevisiae
ttgcgtgaca

SEQ ID NO: 5071 - DNA, 10 bp, Saccharomyces cerevisiae
ttgctatata

SEQ ID NO: 5072 - DNA, 10 bp, Saccharomyces cerevisiae
ttggaaccaa

SEQ ID NO: 5073 - DNA, 10 bp, Saccharomyces cerevisiae
ttggcactgg

SEQ ID NO: 5074 - DNA, 10 bp, Saccharomyces cerevisiae
ttgggttcgt

SEQ ID NO: 5075 - DNA, 10 bp, Saccharomyces cerevisiae
ttggtgcgta

SEQ ID NO: 5076 - DNA, 10 bp, Saccharomyces cerevisiae
ttggtggata

SEQ ID NO: 5077 - DNA, 10 bp, Saccharomyces cerevisiae
ttgtataaaa

SEQ ID NO: 5078 - DNA, 10 bp, Saccharomyces cerevisiae
ttgtatgcca

SEQ ID NO: 5079 - DNA, 10 bp, Saccharomyces cerevisiae
ttgtcactcc

SEQ ID NO: 5080 - DNA, 10 bp, Saccharomyces cerevisiae
ttgtttgcac

SEQ ID NO: 5081 - DNA, 10 bp, Saccharomyces cerevisiae
tttaaaaaaa

SEQ ID NO: 5082 - DNA, 10 bp, Saccharomyces cerevisiae
tttaaagata

SEQ ID NO: 5083 - DNA, 10 bp, Saccharomyces cerevisiae
tttaacattt

SEQ ID NO: 5084 - DNA, 10 bp, Saccharomyces cerevisiae
tttaaccgct

SEQ ID NO: 5085 - DNA, 10 bp, Saccharomyces cerevisiae
tttaagtttc

SEQ ID NO: 5086 - DNA, 10 bp, Saccharomyces cerevisiae
tttaccagtc

SEQ ID NO: 5087 - DNA, 10 bp, Saccharomyces cerevisiae
tttacgtatg

SEQ ID NO: 5088 - DNA, 10 bp, Saccharomyces cerevisiae
tttagcatta

SEQ ID NO: 5089 - DNA, 10 bp, Saccharomyces cerevisiae
tttagggtca

SEQ ID NO: 5090 - DNA, 10 bp, Saccharomyces cerevisiae
tttagtttcg

SEQ ID NO: 5091 - DNA, 10 bp, Saccharomyces cerevisiae
tttatcttgt

SEQ ID NO: 5092 - DNA, 10 bp, Saccharomyces cerevisiae
tttattcaat

SEQ ID NO: 5093 - DNA, 10 bp, Saccharomyces cerevisiae
tttatttttt

SEQ ID NO: 5094 - DNA, 10 bp, Saccharomyces cerevisiae
tttcaagaac

SEQ ID NO: 5095 - DNA, 10 bp, Saccharomyces cerevisiae
tttcaatacc

SEQ ID NO: 5096 - DNA, 10 bp, Saccharomyces cerevisiae
tttcaattgc

SEQ ID NO: 5097 - DNA, 10 bp, Saccharomyces cerevisiae
tttcatttcc

SEQ ID NO: 5098 - DNA, 10 bp, Saccharomyces cerevisiae
tttccagaat

SEQ ID NO: 5099 - DNA, 10 bp, Saccharomyces cerevisiae
tttccattca

SEQ ID NO: 5100 - DNA, 10 bp, Saccharomyces cerevisiae
tttcccaaga

SEQ ID NO: 5101 - DNA, 10 bp, Saccharomyces cerevisiae
tttcttcaac

SEQ ID NO: 5102 - DNA, 10 bp, Saccharomyces cerevisiae
tttgaaagta

SEQ ID NO: 5103 - DNA, 10 bp, Saccharomyces cerevisiae
tttgagcgca

SEQ ID NO: 5104 - DNA, 10 bp, Saccharomyces cerevisiae
tttgcattcc

SEQ ID NO: 5105 - DNA, 10 bp, Saccharomyces cerevisiae
tttgccatcg

SEQ ID NO: 5106 - DNA, 10 bp, Saccharomyces cerevisiae
tttgcctaaa

SEQ ID NO: 5107 - DNA, 10 bp, Saccharomyces cerevisiae
tttgcttggt

SEQ ID NO: 5108 - DNA, 10 bp, Saccharomyces cerevisiae
tttggatagt

SEQ ID NO: 5109 - DNA, 10 bp, Saccharomyces cerevisiae
tttggtcgta

SEQ ID NO: 5110 - DNA, 10 bp, Saccharomyces cerevisiae
tttggtcttg

SEQ ID NO: 5111 - DNA, 10 bp, Saccharomyces cerevisiae
tttggtttca

SEQ ID NO: 5112 - DNA, 10 bp, Saccharomyces cerevisiae
tttggtttcg

SEQ ID NO: 5113 - DNA, 10 bp, Saccharomyces cerevisiae
ttttaaaata

SEQ ID NO: 5114 - DNA, 10 bp, Saccharomyces cerevisiae
ttttaagatt

SEQ ID NO: 5115 - DNA, 10 bp, Saccharomyces cerevisiae
ttttatataa

SEQ ID NO: 5116 - DNA, 10 bp, Saccharomyces cerevisiae
ttttatattt

SEQ ID NO: 5117 - DNA, 10 bp, Saccharomyces cerevisiae
ttttcaaatt

SEQ ID NO: 5118 - DNA, 10 bp, Saccharomyces cerevisiae
ttttccaaaa

SEQ ID NO: 5119 - DNA, 10 bp, Saccharomyces cerevisiae
ttttccaatc

SEQ ID NO: 5120 - DNA, 10 bp, Saccharomyces cerevisiae
ttttcctctt

SEQ ID NO: 5121 - DNA, 10 bp, Saccharomyces cerevisiae
ttttcgacca

SEQ ID NO: 5122 - DNA, 10 bp, Saccharomyces cerevisiae
ttttctttct

SEQ ID NO: 5123 - DNA, 10 bp, Saccharomyces cerevisiae
ttttgatttt

SEQ ID NO: 5124 - DNA, 10 bp, Saccharomyces cerevisiae
ttttgggact

SEQ ID NO: 5125 - DNA, 10 bp, Saccharomyces cerevisiae
tttttaaaaa

SEQ ID NO: 5126 - DNA, 10 bp, Saccharomyces cerevisiae
tttttaagca

SEQ ID NO: 5127 - DNA, 10 bp, Saccharomyces cerevisiae
tttttaatac

SEQ ID NO: 5128 - DNA, 10 bp, Saccharomyces cerevisiae
tttttaatag

SEQ ID NO: 5129 - DNA, 10 bp, Saccharomyces cerevisiae
tttttataat

SEQ ID NO: 5130 - DNA, 10 bp, Saccharomyces cerevisiae
tttttccctt

SEQ ID NO: 5131 - DNA, 10 bp, Saccharomyces cerevisiae
tttttctatt

SEQ ID NO: 5132 - DNA, 10 bp, Saccharomyces cerevisiae
tttttcttaa

SEQ ID NO: 5133 - DNA, 10 bp, Saccharomyces cerevisiae
tttttttgga

SEQ ID NO: 5134 - DNA, 10 bp, Saccharomyces cerevisiae
aaaaaaaaag

SEQ ID NO: 5135 - DNA, 10 bp, Saccharomyces cerevisiae
aaaaaaaaat

SEQ ID NO: 5136 - DNA, 10 bp, Saccharomyces cerevisiae
aaaaaaaatc

SEQ ID NO: 5137 - DNA, 10 bp, Saccharomyces cerevisiae
aaaaaaactc

SEQ ID NO: 5138 - DNA, 10 bp, Saccharomyces cerevisiae
aaaaaaagaa

SEQ ID NO: 5139 - DNA, 10 bp, Saccharomyces cerevisiae
aaaaaaagcg

SEQ ID NO: 5140 - DNA, 10 bp, Saccharomyces cerevisiae
aaaaaaattg

SEQ ID NO: 5141 - DNA, 10 bp, Saccharomyces cerevisiae
aaaaaacaaa

SEQ ID NO: 5142 - DNA, 10 bp, Saccharomyces cerevisiae
aaaaaacgat

SEQ ID NO: 5143 - DNA, 10 bp, Saccharomyces cerevisiae
aaaaaagaga

SEQ ID NO: 5144 - DNA, 10 bp, Saccharomyces cerevisiae
aaaaaaggtc

SEQ ID NO: 5145 - DNA, 10 bp, Saccharomyces cerevisiae
aaaaaataaa

SEQ ID NO: 5146 - DNA, 10 bp, Saccharomyces cerevisiae
aaaaaataat

SEQ ID NO: 5147 - DNA, 10 bp, Saccharomyces cerevisiae
aaaaaatcct

SEQ ID NO: 5148 - DNA, 10 bp, Saccharomyces cerevisiae
aaaaaatctg

SEQ ID NO: 5149 - DNA, 10 bp, Saccharomyces cerevisiae
aaaaaatgca

SEQ ID NO: 5150 - DNA, 10 bp, Saccharomyces cerevisiae
aaaaaattca

SEQ ID NO: 5151 - DNA, 10 bp, Saccharomyces cerevisiae
aaaaaattta

SEQ ID NO: 5152 - DNA, 10 bp, Saccharomyces cerevisiae
aaaaacatct

SEQ ID NO: 5153 - DNA, 10 bp, Saccharomyces cerevisiae
aaaaaccact

SEQ ID NO: 5154 - DNA, 10 bp, Saccharomyces cerevisiae
aaaaacccag

SEQ ID NO: 5155 - DNA, 10 bp, Saccharomyces cerevisiae
aaaaacccat

SEQ ID NO: 5156 - DNA, 10 bp, Saccharomyces cerevisiae
aaaaactatt

SEQ ID NO: 5157 - DNA, 10 bp, Saccharomyces cerevisiae
aaaaactcaa

SEQ ID NO: 5158 - DNA, 10 bp, Saccharomyces cerevisiae
aaaaactcat

SEQ ID NO: 5159 - DNA, 10 bp, Saccharomyces cerevisiae
aaaaactttt

SEQ ID NO: 5160 - DNA, 10 bp, Saccharomyces cerevisiae
aaaaagaaaa

SEQ ID NO: 5161 - DNA, 10 bp, Saccharomyces cerevisiae
aaaaagagac

SEQ ID NO: 5162 - DNA, 10 bp, Saccharomyces cerevisiae
aaaaagagca

SEQ ID NO: 5163 - DNA, 10 bp, Saccharomyces cerevisiae
aaaaagaggg

SEQ ID NO: 5164 - DNA, 10 bp, Saccharomyces cerevisiae
aaaaagcaag

SEQ ID NO: 5165 - DNA, 10 bp, Saccharomyces cerevisiae
aaaaagcaat

SEQ ID NO: 5166 - DNA, 10 bp, Saccharomyces cerevisiae
aaaaaggcga

SEQ ID NO: 5167 - DNA, 10 bp, Saccharomyces cerevisiae
aaaaagtagc

SEQ ID NO: 5168 - DNA, 10 bp, Saccharomyces cerevisiae
aaaaagtcgc

SEQ ID NO: 5169 - DNA, 10 bp, Saccharomyces cerevisiae
aaaaatacga

SEQ ID NO: 5170 - DNA, 10 bp, Saccharomyces cerevisiae
aaaaatcatc

SEQ ID NO: 5171 - DNA, 10 bp, Saccharomyces cerevisiae
aaaaatcccc

SEQ ID NO: 5172 - DNA, 10 bp, Saccharomyces cerevisiae
aaaaatggga

SEQ ID NO: 5173 - DNA, 10 bp, Saccharomyces cerevisiae
aaaaatttca

SEQ ID NO: 5174 - DNA, 10 bp, Saccharomyces cerevisiae
aaaaatttcc

SEQ ID NO: 5175 - DNA, 10 bp, Saccharomyces cerevisiae
aaaaatttgt

SEQ ID NO: 5176 - DNA, 10 bp, Saccharomyces cerevisiae
aaaacaacaa

SEQ ID NO: 5177 - DNA, 10 bp, Saccharomyces cerevisiae
aaaacaagcc

SEQ ID NO: 5178 - DNA, 10 bp, Saccharomyces cerevisiae
aaaacagtga

SEQ ID NO: 5179 - DNA, 10 bp, Saccharomyces cerevisiae
aaaacatatc

SEQ ID NO: 5180 - DNA, 10 bp, Saccharomyces cerevisiae
aaaacccaat

SEQ ID NO: 5181 - DNA, 10 bp, Saccharomyces cerevisiae
aaaacccctt

SEQ ID NO: 5182 - DNA, 10 bp, Saccharomyces cerevisiae
aaaacctttg

SEQ ID NO: 5183 - DNA, 10 bp, Saccharomyces cerevisiae
aaaacgcgta

SEQ ID NO: 5184 - DNA, 10 bp, Saccharomyces cerevisiae
aaaactattc

SEQ ID NO: 5185 - DNA, 10 bp, Saccharomyces cerevisiae
aaaacttggt

SEQ ID NO: 5186 - DNA, 10 bp, Saccharomyces cerevisiae
aaaactttgc

SEQ ID NO: 5187 - DNA, 10 bp, Saccharomyces cerevisiae
aaaagaccta

SEQ ID NO: 5188 - DNA, 10 bp, Saccharomyces cerevisiae
aaaagatctg

SEQ ID NO: 5189 - DNA, 10 bp, Saccharomyces cerevisiae
aaaagcaccc

SEQ ID NO: 5190 - DNA, 10 bp, Saccharomyces cerevisiae
aaaagcgatg

SEQ ID NO: 5191 - DNA, 10 bp, Saccharomyces cerevisiae
aaaagcgcta

SEQ ID NO: 5192 - DNA, 10 bp, Saccharomyces cerevisiae
aaaagcgggg

SEQ ID NO: 5193 - DNA, 10 bp, Saccharomyces cerevisiae
aaaagctaca

SEQ ID NO: 5194 - DNA, 10 bp, Saccharomyces cerevisiae
aaaaggatat

SEQ ID NO: 5195 - DNA, 10 bp, Saccharomyces cerevisiae
aaaaggcacg

SEQ ID NO: 5196 - DNA, 10 bp, Saccharomyces cerevisiae
aaaaggccgt

SEQ ID NO: 5197 - DNA, 10 bp, Saccharomyces cerevisiae
aaaaggggaa

SEQ ID NO: 5198 - DNA, 10 bp, Saccharomyces cerevisiae
aaaaggtaca

SEQ ID NO: 5199 - DNA, 10 bp, Saccharomyces cerevisiae
aaaaggtcat

SEQ ID NO: 5200 - DNA, 10 bp, Saccharomyces cerevisiae
aaaagtacct

SEQ ID NO: 5201 - DNA, 10 bp, Saccharomyces cerevisiae
aaaagtcaca

SEQ ID NO: 5202 - DNA, 10 bp, Saccharomyces cerevisiae
aaaagtccaa

SEQ ID NO: 5203 - DNA, 10 bp, Saccharomyces cerevisiae
aaaagtggtg

SEQ ID NO: 5204 - DNA, 10 bp, Saccharomyces cerevisiae
aaaagtttga

SEQ ID NO: 5205 - DNA, 10 bp, Saccharomyces cerevisiae
aaaataaacc

SEQ ID NO: 5206 - DNA, 10 bp, Saccharomyces cerevisiae
aaaataaata

SEQ ID NO: 5207 - DNA, 10 bp, Saccharomyces cerevisiae
aaaataaggc

SEQ ID NO: 5208 - DNA, 10 bp, Saccharomyces cerevisiae
aaaataatct

SEQ ID NO: 5209 - DNA, 10 bp, Saccharomyces cerevisiae
aaaatacaga

SEQ ID NO: 5210 - DNA, 10 bp, Saccharomyces cerevisiae
aaaatactac

SEQ ID NO: 5211 - DNA, 10 bp, Saccharomyces cerevisiae
aaaatactat

SEQ ID NO: 5212 - DNA, 10 bp, Saccharomyces cerevisiae
aaaatagctt

SEQ ID NO: 5213 - DNA, 10 bp, Saccharomyces cerevisiae
aaaatcaact

SEQ ID NO: 5214 - DNA, 10 bp, Saccharomyces cerevisiae
aaaatctggt

SEQ ID NO: 5215 - DNA, 10 bp, Saccharomyces cerevisiae
aaaatgagaa

SEQ ID NO: 5216 - DNA, 10 bp, Saccharomyces cerevisiae
aaaatgcatc

SEQ ID NO: 5217 - DNA, 10 bp, Saccharomyces cerevisiae
aaaatgctaa

SEQ ID NO: 5218 - DNA, 10 bp, Saccharomyces cerevisiae
aaaatggaaa

SEQ ID NO: 5219 - DNA, 10 bp, Saccharomyces cerevisiae
aaaatgtaga

SEQ ID NO: 5220 - DNA, 10 bp, Saccharomyces cerevisiae
aaaatgttta

SEQ ID NO: 5221 - DNA, 10 bp, Saccharomyces cerevisiae
aaaattaagg

SEQ ID NO: 5222 - DNA, 10 bp, Saccharomyces cerevisiae
aaaattagtt

SEQ ID NO: 5223 - DNA, 10 bp, Saccharomyces cerevisiae
aaaattcctt

SEQ ID NO: 5224 - DNA, 10 bp, Saccharomyces cerevisiae
aaaattggaa

SEQ ID NO: 5225 - DNA, 10 bp, Saccharomyces cerevisiae
aaaatttgaa

SEQ ID NO: 5226 - DNA, 10 bp, Saccharomyces cerevisiae
aaaattttat

SEQ ID NO: 5227 - DNA, 10 bp, Saccharomyces cerevisiae
aaacaaaacc

SEQ ID NO: 5228 - DNA, 10 bp, Saccharomyces cerevisiae
aaacaaacgt

SEQ ID NO: 5229 - DNA, 10 bp, Saccharomyces cerevisiae
aaacaaagac

SEQ ID NO: 5230 - DNA, 10 bp, Saccharomyces cerevisiae
aaacaaagtg

SEQ ID NO: 5231 - DNA, 10 bp, Saccharomyces cerevisiae
aaacaaatct

SEQ ID NO: 5232 - DNA, 10 bp, Saccharomyces cerevisiae
aaacaaggtc

SEQ ID NO: 5233 - DNA, 10 bp, Saccharomyces cerevisiae
aaacacaaaa

SEQ ID NO: 5234 - DNA, 10 bp, Saccharomyces cerevisiae
aaacacacag

SEQ ID NO: 5235 - DNA, 10 bp, Saccharomyces cerevisiae
aaacacccac

SEQ ID NO: 5236 - DNA, 10 bp, Saccharomyces cerevisiae
aaacaccgac

SEQ ID NO: 5237 - DNA, 10 bp, Saccharomyces cerevisiae
aaacagaagc

SEQ ID NO: 5238 - DNA, 10 bp, Saccharomyces cerevisiae
aaacagagca

SEQ ID NO: 5239 - DNA, 10 bp, Saccharomyces cerevisiae
aaacataaaa

SEQ ID NO: 5240 - DNA, 10 bp, Saccharomyces cerevisiae
aaaccaactc

SEQ ID NO: 5241 - DNA, 10 bp, Saccharomyces cerevisiae
aaaccaccta

SEQ ID NO: 5242 - DNA, 10 bp, Saccharomyces cerevisiae
aaaccattgc

SEQ ID NO: 5243 - DNA, 10 bp, Saccharomyces cerevisiae
aaacccgaat

SEQ ID NO: 5244 - DNA, 10 bp, Saccharomyces cerevisiae
aaaccgaatt

SEQ ID NO: 5245 - DNA, 10 bp, Saccharomyces cerevisiae
aaaccgccat

SEQ ID NO: 5246 - DNA, 10 bp, Saccharomyces cerevisiae
aaaccggctg

SEQ ID NO: 5247 - DNA, 10 bp, Saccharomyces cerevisiae
aaaccgtcat

SEQ ID NO: 5248 - DNA, 10 bp, Saccharomyces cerevisiae
aaaccttgag

SEQ ID NO: 5249 - DNA, 10 bp, Saccharomyces cerevisiae
aaacgaaacc

SEQ ID NO: 5250 - DNA, 10 bp, Saccharomyces cerevisiae
aaacgacgac

SEQ ID NO: 5251 - DNA, 10 bp, Saccharomyces cerevisiae
aaacgatacc

SEQ ID NO: 5252 - DNA, 10 bp, Saccharomyces cerevisiae
aaacgattag

SEQ ID NO: 5253 - DNA, 10 bp, Saccharomyces cerevisiae
aaacgcagaa

SEQ ID NO: 5254 - DNA, 10 bp, Saccharomyces cerevisiae
aaacgccgct

SEQ ID NO: 5255 - DNA, 10 bp, Saccharomyces cerevisiae
aaacgcgaag

SEQ ID NO: 5256 - DNA, 10 bp, Saccharomyces cerevisiae
aaacgggagc

SEQ ID NO: 5257 - DNA, 10 bp, Saccharomyces cerevisiae
aaacggggta

SEQ ID NO: 5258 - DNA, 10 bp, Saccharomyces cerevisiae
aaacgtagga

SEQ ID NO: 5259 - DNA, 10 bp, Saccharomyces cerevisiae
aaactaaaac

SEQ ID NO: 5260 - DNA, 10 bp, Saccharomyces cerevisiae
aaactaactc

SEQ ID NO: 5261 - DNA, 10 bp, Saccharomyces cerevisiae
aaactaggaa

SEQ ID NO: 5262 - DNA, 10 bp, Saccharomyces cerevisiae
aaactataca

SEQ ID NO: 5263 - DNA, 10 bp, Saccharomyces cerevisiae
aaactatcct

SEQ ID NO: 5264 - DNA, 10 bp, Saccharomyces cerevisiae
aaactctgcc

SEQ ID NO: 5265 - DNA, 10 bp, Saccharomyces cerevisiae
aaactgaaaa

SEQ ID NO: 5266 - DNA, 10 bp, Saccharomyces cerevisiae
aaactggggt

SEQ ID NO: 5267 - DNA, 10 bp, Saccharomyces cerevisiae
aaactgtgct

SEQ ID NO: 5268 - DNA, 10 bp, Saccharomyces cerevisiae
aaactgttga

SEQ ID NO: 5269 - DNA, 10 bp, Saccharomyces cerevisiae
aaactttatg

SEQ ID NO: 5270 - DNA, 10 bp, Saccharomyces cerevisiae
aaactttttt

SEQ ID NO: 5271 - DNA, 10 bp, Saccharomyces cerevisiae
aaagaaattc

SEQ ID NO: 5272 - DNA, 10 bp, Saccharomyces cerevisiae
aaagaactgt

SEQ ID NO: 5273 - DNA, 10 bp, Saccharomyces cerevisiae
aaagaacttc

SEQ ID NO: 5274 - DNA, 10 bp, Saccharomyces cerevisiae
aaagaagaac

SEQ ID NO: 5275 - DNA, 10 bp, Saccharomyces cerevisiae
aaagaagata

SEQ ID NO: 5276 - DNA, 10 bp, Saccharomyces cerevisiae
aaagaatata

SEQ ID NO: 5277 - DNA, 10 bp, Saccharomyces cerevisiae
aaagaatctc

SEQ ID NO: 5278 - DNA, 10 bp, Saccharomyces cerevisiae
aaagacaaaa

SEQ ID NO: 5279 - DNA, 10 bp, Saccharomyces cerevisiae
aaagacaaac

SEQ ID NO: 5280 - DNA, 10 bp, Saccharomyces cerevisiae
aaagacaggg

SEQ ID NO: 5281 - DNA, 10 bp, Saccharomyces cerevisiae
aaagaccaga

SEQ ID NO: 5282 - DNA, 10 bp, Saccharomyces cerevisiae
aaagacctac

SEQ ID NO: 5283 - DNA, 10 bp, Saccharomyces cerevisiae
aaagacgaag

SEQ ID NO: 5284 - DNA, 10 bp, Saccharomyces cerevisiae
aaagacgcgc

SEQ ID NO: 5285 - DNA, 10 bp, Saccharomyces cerevisiae
aaagacggag

SEQ ID NO: 5286 - DNA, 10 bp, Saccharomyces cerevisiae
aaagacgtat

SEQ ID NO: 5287 - DNA, 10 bp, Saccharomyces cerevisiae
aaagactact

SEQ ID NO: 5288 - DNA, 10 bp, Saccharomyces cerevisiae
aaagactcaa

SEQ ID NO: 5289 - DNA, 10 bp, Saccharomyces cerevisiae
aaagagatca

SEQ ID NO: 5290 - DNA, 10 bp, Saccharomyces cerevisiae
aaagagccca

SEQ ID NO: 5291 - DNA, 10 bp, Saccharomyces cerevisiae
aaagataaag

SEQ ID NO: 5292 - DNA, 10 bp, Saccharomyces cerevisiae
aaagattgcg

SEQ ID NO: 5293 - DNA, 10 bp, Saccharomyces cerevisiae
aaagcaccac

SEQ ID NO: 5294 - DNA, 10 bp, Saccharomyces cerevisiae
aaagcataat

SEQ ID NO: 5295 - DNA, 10 bp, Saccharomyces cerevisiae
aaagccagaa

SEQ ID NO: 5296 - DNA, 10 bp, Saccharomyces cerevisiae
aaagccagac

SEQ ID NO: 5297 - DNA, 10 bp, Saccharomyces cerevisiae
aaagccccaa

SEQ ID NO: 5298 - DNA, 10 bp, Saccharomyces cerevisiae
aaagcgatga

SEQ ID NO: 5299 - DNA, 10 bp, Saccharomyces cerevisiae
aaagcggtat

SEQ ID NO: 5300 - DNA, 10 bp, Saccharomyces cerevisiae
aaagctaaag

SEQ ID NO: 5301 - DNA, 10 bp, Saccharomyces cerevisiae
aaagctaacc

SEQ ID NO: 5302 - DNA, 10 bp, Saccharomyces cerevisiae
aaagctagca

SEQ ID NO: 5303 - DNA, 10 bp, Saccharomyces cerevisiae
aaagctccag

SEQ ID NO: 5304 - DNA, 10 bp, Saccharomyces cerevisiae
aaagctgatg

SEQ ID NO: 5305 - DNA, 10 bp, Saccharomyces cerevisiae
aaagcttttt

SEQ ID NO: 5306 - DNA, 10 bp, Saccharomyces cerevisiae
aaaggaattg

SEQ ID NO: 5307 - DNA, 10 bp, Saccharomyces cerevisiae
aaaggaattt

SEQ ID NO: 5308 - DNA, 10 bp, Saccharomyces cerevisiae
aaaggagtga

SEQ ID NO: 5309 - DNA, 10 bp, Saccharomyces cerevisiae
aaaggatacc

SEQ ID NO: 5310 - DNA, 10 bp, Saccharomyces cerevisiae
aaaggccaga

SEQ ID NO: 5311 - DNA, 10 bp, Saccharomyces cerevisiae
aaaggcctgc

SEQ ID NO: 5312 - DNA, 10 bp, Saccharomyces cerevisiae
aaaggcgagg

SEQ ID NO: 5313 - DNA, 10 bp, Saccharomyces cerevisiae
aaaggcgggg

SEQ ID NO: 5314 - DNA, 10 bp, Saccharomyces cerevisiae
aaagggcaca

SEQ ID NO: 5315 - DNA, 10 bp, Saccharomyces cerevisiae
aaaggggtgc

SEQ ID NO: 5316 - DNA, 10 bp, Saccharomyces cerevisiae
aaaggtaaag

SEQ ID NO: 5317 - DNA, 10 bp, Saccharomyces cerevisiae
aaaggtctca

SEQ ID NO: 5318 - DNA, 10 bp, Saccharomyces cerevisiae
aaaggtttaa

SEQ ID NO: 5319 - DNA, 10 bp, Saccharomyces cerevisiae
aaagtatcac

SEQ ID NO: 5320 - DNA, 10 bp, Saccharomyces cerevisiae
aaagtatgcc

SEQ ID NO: 5321 - DNA, 10 bp, Saccharomyces cerevisiae
aaagtcagag

SEQ ID NO: 5322 - DNA, 10 bp, Saccharomyces cerevisiae
aaagtcccca

SEQ ID NO: 5323 - DNA, 10 bp, Saccharomyces cerevisiae
aaagtcgata

SEQ ID NO: 5324 - DNA, 10 bp, Saccharomyces cerevisiae
aaagtgcacg

SEQ ID NO: 5325 - DNA, 10 bp, Saccharomyces cerevisiae
aaagtgcgcg

SEQ ID NO: 5326 - DNA, 10 bp, Saccharomyces cerevisiae
aaagtgcttg

SEQ ID NO: 5327 - DNA, 10 bp, Saccharomyces cerevisiae
aaagtgtggc

SEQ ID NO: 5328 - DNA, 10 bp, Saccharomyces cerevisiae
aaagttaggt

SEQ ID NO: 5329 - DNA, 10 bp, Saccharomyces cerevisiae
aaagtttacc

SEQ ID NO: 5330 - DNA, 10 bp, Saccharomyces cerevisiae
aaagtttctt

SEQ ID NO: 5331 - DNA, 10 bp, Saccharomyces cerevisiae
aaataaatga

SEQ ID NO: 5332 - DNA, 10 bp, Saccharomyces cerevisiae
aaataaattc

SEQ ID NO: 5333 - DNA, 10 bp, Saccharomyces cerevisiae
aaataacaaa

SEQ ID NO: 5334 - DNA, 10 bp, Saccharomyces cerevisiae
aaataagtaa

SEQ ID NO: 5335 - DNA, 10 bp, Saccharomyces cerevisiae
aaataagtat

SEQ ID NO: 5336 - DNA, 10 bp, Saccharomyces cerevisiae
aaataataaa

SEQ ID NO: 5337 - DNA, 10 bp, Saccharomyces cerevisiae
aaataataac

SEQ ID NO: 5338 - DNA, 10 bp, Saccharomyces cerevisiae
aaataatatc

SEQ ID NO: 5339 - DNA, 10 bp, Saccharomyces cerevisiae
aaataatgtt

SEQ ID NO: 5340 - DNA, 10 bp, Saccharomyces cerevisiae
aaataccgta

SEQ ID NO: 5341 - DNA, 10 bp, Saccharomyces cerevisiae
aaatacgact

SEQ ID NO: 5342 - DNA, 10 bp, Saccharomyces cerevisiae
aaatagtggt

SEQ ID NO: 5343 - DNA, 10 bp, Saccharomyces cerevisiae
aaatataaat

SEQ ID NO: 5344 - DNA, 10 bp, Saccharomyces cerevisiae
aaatatatct

SEQ ID NO: 5345 - DNA, 10 bp, Saccharomyces cerevisiae
aaatattcat

SEQ ID NO: 5346 - DNA, 10 bp, Saccharomyces cerevisiae
aaatattttt

SEQ ID NO: 5347 - DNA, 10 bp, Saccharomyces cerevisiae
aaatcaacac

SEQ ID NO: 5348 - DNA, 10 bp, Saccharomyces cerevisiae
aaatcaagat

SEQ ID NO: 5349 - DNA, 10 bp, Saccharomyces cerevisiae
aaatcattag

SEQ ID NO: 5350 - DNA, 10 bp, Saccharomyces cerevisiae
aaatcattat

SEQ ID NO: 5351 - DNA, 10 bp, Saccharomyces cerevisiae
aaatcatttt

SEQ ID NO: 5352 - DNA, 10 bp, Saccharomyces cerevisiae
aaatccttca

SEQ ID NO: 5353 - DNA, 10 bp, Saccharomyces cerevisiae
aaatcgaagg

SEQ ID NO: 5354 - DNA, 10 bp, Saccharomyces cerevisiae
aaatcgaatc

SEQ ID NO: 5355 - DNA, 10 bp, Saccharomyces cerevisiae
aaatcttgaa

SEQ ID NO: 5356 - DNA, 10 bp, Saccharomyces cerevisiae
aaatgaattc

SEQ ID NO: 5357 - DNA, 10 bp, Saccharomyces cerevisiae
aaatgacgat

SEQ ID NO: 5358 - DNA, 10 bp, Saccharomyces cerevisiae
aaatgacttt

SEQ ID NO: 5359 - DNA, 10 bp, Saccharomyces cerevisiae
aaatgagtgg

SEQ ID NO: 5360 - DNA, 10 bp, Saccharomyces cerevisiae
aaatgatagc

SEQ ID NO: 5361 - DNA, 10 bp, Saccharomyces cerevisiae
aaatgattaa

SEQ ID NO: 5362 - DNA, 10 bp, Saccharomyces cerevisiae
aaatgctcgt

SEQ ID NO: 5363 - DNA, 10 bp, Saccharomyces cerevisiae
aaatggaatt

SEQ ID NO: 5364 - DNA, 10 bp, Saccharomyces cerevisiae
aaatggatga

SEQ ID NO: 5365 - DNA, 10 bp, Saccharomyces cerevisiae
aaatgtagga

SEQ ID NO: 5366 - DNA, 10 bp, Saccharomyces cerevisiae
aaatgtataa

SEQ ID NO: 5367 - DNA, 10 bp, Saccharomyces cerevisiae
aaatgttact

SEQ ID NO: 5368 - DNA, 10 bp, Saccharomyces cerevisiae
aaatgttatt

SEQ ID NO: 5369 - DNA, 10 bp, Saccharomyces cerevisiae
aaattaaagc

SEQ ID NO: 5370 - DNA, 10 bp, Saccharomyces cerevisiae
aaattagatg

SEQ ID NO: 5371 - DNA, 10 bp, Saccharomyces cerevisiae
aaattatcaa

SEQ ID NO: 5372 - DNA, 10 bp, Saccharomyces cerevisiae
aaattcattt

SEQ ID NO: 5373 - DNA, 10 bp, Saccharomyces cerevisiae
aaattccaaa

SEQ ID NO: 5374 - DNA, 10 bp, Saccharomyces cerevisiae
aaattcgaaa

SEQ ID NO: 5375 - DNA, 10 bp, Saccharomyces cerevisiae
aaattcgtca

SEQ ID NO: 5376 - DNA, 10 bp, Saccharomyces cerevisiae
aaattctcta

SEQ ID NO: 5377 - DNA, 10 bp, Saccharomyces cerevisiae
aaattgaaaa

SEQ ID NO: 5378 - DNA, 10 bp, Saccharomyces cerevisiae
aaattgagaa

SEQ ID NO: 5379 - DNA, 10 bp, Saccharomyces cerevisiae
aaattgggcg

SEQ ID NO: 5380 - DNA, 10 bp, Saccharomyces cerevisiae
aaattggtgc

SEQ ID NO: 5381 - DNA, 10 bp, Saccharomyces cerevisiae
aaattgttcc

SEQ ID NO: 5382 - DNA, 10 bp, Saccharomyces cerevisiae
aaatttagtt

SEQ ID NO: 5383 - DNA, 10 bp, Saccharomyces cerevisiae
aaatttatac

SEQ ID NO: 5384 - DNA, 10 bp, Saccharomyces cerevisiae
aaatttcata

SEQ ID NO: 5385 - DNA, 10 bp, Saccharomyces cerevisiae
aaatttcgtt

SEQ ID NO: 5386 - DNA, 10 bp, Saccharomyces cerevisiae
aaatttctcg

SEQ ID NO: 5387 - DNA, 10 bp, Saccharomyces cerevisiae
aaatttctgc

SEQ ID NO: 5388 - DNA, 10 bp, Saccharomyces cerevisiae
aaatttcttc

SEQ ID NO: 5389 - DNA, 10 bp, Saccharomyces cerevisiae
aaatttgtgt

SEQ ID NO: 5390 - DNA, 10 bp, Saccharomyces cerevisiae
aaattttaca

SEQ ID NO: 5391 - DNA, 10 bp, Saccharomyces cerevisiae
aaattttttt

SEQ ID NO: 5392 - DNA, 10 bp, Saccharomyces cerevisiae
aacaaaagga

SEQ ID NO: 5393 - DNA, 10 bp, Saccharomyces cerevisiae
aacaaaaggg

SEQ ID NO: 5394 - DNA, 10 bp, Saccharomyces cerevisiae
aacaaagacc

SEQ ID NO: 5395 - DNA, 10 bp, Saccharomyces cerevisiae
aacaaaggga

SEQ ID NO: 5396 - DNA, 10 bp, Saccharomyces cerevisiae
aacaaatata

SEQ ID NO: 5397 - DNA, 10 bp, Saccharomyces cerevisiae
aacaaatcag

SEQ ID NO: 5398 - DNA, 10 bp, Saccharomyces cerevisiae
aacaacaact

SEQ ID NO: 5399 - DNA, 10 bp, Saccharomyces cerevisiae
aacaacaagc

SEQ ID NO: 5400 - DNA, 10 bp, Saccharomyces cerevisiae
aacaactctt

SEQ ID NO: 5401 - DNA, 10 bp, Saccharomyces cerevisiae
aacaagcctt

SEQ ID NO: 5402 - DNA, 10 bp, Saccharomyces cerevisiae
aacaagcggt

SEQ ID NO: 5403 - DNA, 10 bp, Saccharomyces cerevisiae
aacaaggtgg

SEQ ID NO: 5404 - DNA, 10 bp, Saccharomyces cerevisiae
aacaagtacc

SEQ ID NO: 5405 - DNA, 10 bp, Saccharomyces cerevisiae
aacaagtcca

SEQ ID NO: 5406 - DNA, 10 bp, Saccharomyces cerevisiae
aacaatatct

SEQ ID NO: 5407 - DNA, 10 bp, Saccharomyces cerevisiae
aacaatcaaa

SEQ ID NO: 5408 - DNA, 10 bp, Saccharomyces cerevisiae
aacaatcaat

SEQ ID NO: 5409 - DNA, 10 bp, Saccharomyces cerevisiae
aacaatccgt

SEQ ID NO: 5410 - DNA, 10 bp, Saccharomyces cerevisiae
aacacaaaat

SEQ ID NO: 5411 - DNA, 10 bp, Saccharomyces cerevisiae
aacacaaagc

SEQ ID NO: 5412 - DNA, 10 bp, Saccharomyces cerevisiae
aacacaagcc

SEQ ID NO: 5413 - DNA, 10 bp, Saccharomyces cerevisiae
aacacacctt

SEQ ID NO: 5414 - DNA, 10 bp, Saccharomyces cerevisiae
aacacatcaa

SEQ ID NO: 5415 - DNA, 10 bp, Saccharomyces cerevisiae
aacaccactc

SEQ ID NO: 5416 - DNA, 10 bp, Saccharomyces cerevisiae
aacaccatca

SEQ ID NO: 5417 - DNA, 10 bp, Saccharomyces cerevisiae
aacacccctt

SEQ ID NO: 5418 - DNA, 10 bp, Saccharomyces cerevisiae
aacaccgctt

SEQ ID NO: 5419 - DNA, 10 bp, Saccharomyces cerevisiae
aacacgaaga

SEQ ID NO: 5420 - DNA, 10 bp, Saccharomyces cerevisiae
aacacgacaa

SEQ ID NO: 5421 - DNA, 10 bp, Saccharomyces cerevisiae
aacacgatgg

SEQ ID NO: 5422 - DNA, 10 bp, Saccharomyces cerevisiae
aacacggagt

SEQ ID NO: 5423 - DNA, 10 bp, Saccharomyces cerevisiae
aacactaggc

SEQ ID NO: 5424 - DNA, 10 bp, Saccharomyces cerevisiae
aacactttaa

SEQ ID NO: 5425 - DNA, 10 bp, Saccharomyces cerevisiae
aacagaaatt

SEQ ID NO: 5426 - DNA, 10 bp, Saccharomyces cerevisiae
aacagagatg

SEQ ID NO: 5427 - DNA, 10 bp, Saccharomyces cerevisiae
aacagatcag

SEQ ID NO: 5428 - DNA, 10 bp, Saccharomyces cerevisiae
aacagcagcc

SEQ ID NO: 5429 - DNA, 10 bp, Saccharomyces cerevisiae
aacaggctca

SEQ ID NO: 5430 - DNA, 10 bp, Saccharomyces cerevisiae
aacagtacgt

SEQ ID NO: 5431 - DNA, 10 bp, Saccharomyces cerevisiae
aacagtttca

SEQ ID NO: 5432 - DNA, 10 bp, Saccharomyces cerevisiae
aacagtttgg

SEQ ID NO: 5433 - DNA, 10 bp, Saccharomyces cerevisiae
aacataataa

SEQ ID NO: 5434 - DNA, 10 bp, Saccharomyces cerevisiae
aacataatat

SEQ ID NO: 5435 - DNA, 10 bp, Saccharomyces cerevisiae
aacataccag

SEQ ID NO: 5436 - DNA, 10 bp, Saccharomyces cerevisiae
aacatatagc

SEQ ID NO: 5437 - DNA, 10 bp, Saccharomyces cerevisiae
aacatatgca

SEQ ID NO: 5438 - DNA, 10 bp, Saccharomyces cerevisiae
aacatcaaga

SEQ ID NO: 5439 - DNA, 10 bp, Saccharomyces cerevisiae
aacatcagtg

SEQ ID NO: 5440 - DNA, 10 bp, Saccharomyces cerevisiae
aacatccaat

SEQ ID NO: 5441 - DNA, 10 bp, Saccharomyces cerevisiae
aacattattt

SEQ ID NO: 5442 - DNA, 10 bp, Saccharomyces cerevisiae
aacattcaat

SEQ ID NO: 5443 - DNA, 10 bp, Saccharomyces cerevisiae
aacatttacc

SEQ ID NO: 5444 - DNA, 10 bp, Saccharomyces cerevisiae
aacatttttt

SEQ ID NO: 5445 - DNA, 10 bp, Saccharomyces cerevisiae
aaccaaacct

SEQ ID NO: 5446 - DNA, 10 bp, Saccharomyces cerevisiae
aaccaaactg

SEQ ID NO: 5447 - DNA, 10 bp, Saccharomyces cerevisiae
aaccaaagct

SEQ ID NO: 5448 - DNA, 10 bp, Saccharomyces cerevisiae
aaccaaggcg

SEQ ID NO: 5449 - DNA, 10 bp, Saccharomyces cerevisiae
aaccaatttg

SEQ ID NO: 5450 - DNA, 10 bp, Saccharomyces cerevisiae
aaccactcaa

SEQ ID NO: 5451 - DNA, 10 bp, Saccharomyces cerevisiae
aaccagacca

SEQ ID NO: 5452 - DNA, 10 bp, Saccharomyces cerevisiae
aaccagcgaa

SEQ ID NO: 5453 - DNA, 10 bp, Saccharomyces cerevisiae
aaccatatga

SEQ ID NO: 5454 - DNA, 10 bp, Saccharomyces cerevisiae
aacccagttg

SEQ ID NO: 5455 - DNA, 10 bp, Saccharomyces cerevisiae
aaccccagtt

SEQ ID NO: 5456 - DNA, 10 bp, Saccharomyces cerevisiae
aacccggaca

SEQ ID NO: 5457 - DNA, 10 bp, Saccharomyces cerevisiae
aaccctccgt

SEQ ID NO: 5458 - DNA, 10 bp, Saccharomyces cerevisiae
aacccttcca

SEQ ID NO: 5459 - DNA, 10 bp, Saccharomyces cerevisiae
aaccggaaaa

SEQ ID NO: 5460 - DNA, 10 bp, Saccharomyces cerevisiae
aacctacaca

SEQ ID NO: 5461 - DNA, 10 bp, Saccharomyces cerevisiae
aacctagaaa

SEQ ID NO: 5462 - DNA, 10 bp, Saccharomyces cerevisiae
aacctattgg

SEQ ID NO: 5463 - DNA, 10 bp, Saccharomyces cerevisiae
aacctccagt

SEQ ID NO: 5464 - DNA, 10 bp, Saccharomyces cerevisiae
aacctcctct

SEQ ID NO: 5465 - DNA, 10 bp, Saccharomyces cerevisiae
aacctgttgt

SEQ ID NO: 5466 - DNA, 10 bp, Saccharomyces cerevisiae
aaccttgacc

SEQ ID NO: 5467 - DNA, 10 bp, Saccharomyces cerevisiae
aaccttgggt

SEQ ID NO: 5468 - DNA, 10 bp, Saccharomyces cerevisiae
aaccttttga

SEQ ID NO: 5469 - DNA, 10 bp, Saccharomyces cerevisiae
aacgaaaaaa

SEQ ID NO: 5470 - DNA, 10 bp, Saccharomyces cerevisiae
aacgaaaaga

SEQ ID NO: 5471 - DNA, 10 bp, Saccharomyces cerevisiae
aacgaaagta

SEQ ID NO: 5472 - DNA, 10 bp, Saccharomyces cerevisiae
aacgaacagt

SEQ ID NO: 5473 - DNA, 10 bp, Saccharomyces cerevisiae
aacgaatcgt

SEQ ID NO: 5474 - DNA, 10 bp, Saccharomyces cerevisiae
aacgaatttt

SEQ ID NO: 5475 - DNA, 10 bp, Saccharomyces cerevisiae
aacgacagag

SEQ ID NO: 5476 - DNA, 10 bp, Saccharomyces cerevisiae
aacgaccagg

SEQ ID NO: 5477 - DNA, 10 bp, Saccharomyces cerevisiae
aacgacctga

SEQ ID NO: 5478 - DNA, 10 bp, Saccharomyces cerevisiae
aacgatacga

SEQ ID NO: 5479 - DNA, 10 bp, Saccharomyces cerevisiae
aacgatcctt

SEQ ID NO: 5480 - DNA, 10 bp, Saccharomyces cerevisiae
aacgcatata

SEQ ID NO: 5481 - DNA, 10 bp, Saccharomyces cerevisiae
aacgcatttc

SEQ ID NO: 5482 - DNA, 10 bp, Saccharomyces cerevisiae
aacgctatga

SEQ ID NO: 5483 - DNA, 10 bp, Saccharomyces cerevisiae
aacgcttaaa

SEQ ID NO: 5484 - DNA, 10 bp, Saccharomyces cerevisiae
aacgcttctc

SEQ ID NO: 5485 - DNA, 10 bp, Saccharomyces cerevisiae
aacgctttta

SEQ ID NO: 5486 - DNA, 10 bp, Saccharomyces cerevisiae
aacggaccag

SEQ ID NO: 5487 - DNA, 10 bp, Saccharomyces cerevisiae
aacggagaga

SEQ ID NO: 5488 - DNA, 10 bp, Saccharomyces cerevisiae
aacggataga

SEQ ID NO: 5489 - DNA, 10 bp, Saccharomyces cerevisiae
aacggcaatt

SEQ ID NO: 5490 - DNA, 10 bp, Saccharomyces cerevisiae
aacggccgaa

SEQ ID NO: 5491 - DNA, 10 bp, Saccharomyces cerevisiae
aacggtcgtg

SEQ ID NO: 5492 - DNA, 10 bp, Saccharomyces cerevisiae
aacgtcaata

SEQ ID NO: 5493 - DNA, 10 bp, Saccharomyces cerevisiae
aacgtcacca

SEQ ID NO: 5494 - DNA, 10 bp, Saccharomyces cerevisiae
aacgtcgagc

SEQ ID NO: 5495 - DNA, 10 bp, Saccharomyces cerevisiae
aacgtctgga

SEQ ID NO: 5496 - DNA, 10 bp, Saccharomyces cerevisiae
aacgtgtcgt

SEQ ID NO: 5497 - DNA, 10 bp, Saccharomyces cerevisiae
aacgttccaa

SEQ ID NO: 5498 - DNA, 10 bp, Saccharomyces cerevisiae
aacgtttcga

SEQ ID NO: 5499 - DNA, 10 bp, Saccharomyces cerevisiae
aactaaactc

SEQ ID NO: 5500 - DNA, 10 bp, Saccharomyces cerevisiae
aactaaactt

SEQ ID NO: 5501 - DNA, 10 bp, Saccharomyces cerevisiae
aactaaatat

SEQ ID NO: 5502 - DNA, 10 bp, Saccharomyces cerevisiae
aactaagccc

SEQ ID NO: 5503 - DNA, 10 bp, Saccharomyces cerevisiae
aactacattc

SEQ ID NO: 5504 - DNA, 10 bp, Saccharomyces cerevisiae
aactaccgtc

SEQ ID NO: 5505 - DNA, 10 bp, Saccharomyces cerevisiae
aactaccgtt

SEQ ID NO: 5506 - DNA, 10 bp, Saccharomyces cerevisiae
aactacttcg

SEQ ID NO: 5507 - DNA, 10 bp, Saccharomyces cerevisiae
aactagactg

SEQ ID NO: 5508 - DNA, 10 bp, Saccharomyces cerevisiae
aactatacca

SEQ ID NO: 5509 - DNA, 10 bp, Saccharomyces cerevisiae
aactatttaa

SEQ ID NO: 5510 - DNA, 10 bp, Saccharomyces cerevisiae
aactcagatg

SEQ ID NO: 5511 - DNA, 10 bp, Saccharomyces cerevisiae
aactcggtat

SEQ ID NO: 5512 - DNA, 10 bp, Saccharomyces cerevisiae
aactctcaag

SEQ ID NO: 5513 - DNA, 10 bp, Saccharomyces cerevisiae
aactctctgt

SEQ ID NO: 5514 - DNA, 10 bp, Saccharomyces cerevisiae
aactctctta

SEQ ID NO: 5515 - DNA, 10 bp, Saccharomyces cerevisiae
aactctgact

SEQ ID NO: 5516 - DNA, 10 bp, Saccharomyces cerevisiae
aactgaaaga

SEQ ID NO: 5517 - DNA, 10 bp, Saccharomyces cerevisiae
aactgaatgt

SEQ ID NO: 5518 - DNA, 10 bp, Saccharomyces cerevisiae
aactgacccg

SEQ ID NO: 5519 - DNA, 10 bp, Saccharomyces cerevisiae
aactgaccga

SEQ ID NO: 5520 - DNA, 10 bp, Saccharomyces cerevisiae
aactgagcag

SEQ ID NO: 5521 - DNA, 10 bp, Saccharomyces cerevisiae
aactgaggtc

SEQ ID NO: 5522 - DNA, 10 bp, Saccharomyces cerevisiae
aactgattat

SEQ ID NO: 5523 - DNA, 10 bp, Saccharomyces cerevisiae
aactgccttt

SEQ ID NO: 5524 - DNA, 10 bp, Saccharomyces cerevisiae
aactggaaaa

SEQ ID NO: 5525 - DNA, 10 bp, Saccharomyces cerevisiae
aactggccat

SEQ ID NO: 5526 - DNA, 10 bp, Saccharomyces cerevisiae
aactggggct

SEQ ID NO: 5527 - DNA, 10 bp, Saccharomyces cerevisiae
aactgtagtc

SEQ ID NO: 5528 - DNA, 10 bp, Saccharomyces cerevisiae
aactgtgctt

SEQ ID NO: 5529 - DNA, 10 bp, Saccharomyces cerevisiae
aacttaactt

SEQ ID NO: 5530 - DNA, 10 bp, Saccharomyces cerevisiae
aacttagtgt

SEQ ID NO: 5531 - DNA, 10 bp, Saccharomyces cerevisiae
aacttcaaga

SEQ ID NO: 5532 - DNA, 10 bp, Saccharomyces cerevisiae
aacttcgaat

SEQ ID NO: 5533 - DNA, 10 bp, Saccharomyces cerevisiae
aacttctgaa

SEQ ID NO: 5534 - DNA, 10 bp, Saccharomyces cerevisiae
aacttcttgt

SEQ ID NO: 5535 - DNA, 10 bp, Saccharomyces cerevisiae
aacttgcctc

SEQ ID NO: 5536 - DNA, 10 bp, Saccharomyces cerevisiae
aacttgtgga

SEQ ID NO: 5537 - DNA, 10 bp, Saccharomyces cerevisiae
aactttacta

SEQ ID NO: 5538 - DNA, 10 bp, Saccharomyces cerevisiae
aactttcaaa

SEQ ID NO: 5539 - DNA, 10 bp, Saccharomyces cerevisiae
aactttctcg

SEQ ID NO: 5540 - DNA, 10 bp, Saccharomyces cerevisiae
aactttggag

SEQ ID NO: 5541 - DNA, 10 bp, Saccharomyces cerevisiae
aactttgtga

SEQ ID NO: 5542 - DNA, 10 bp, Saccharomyces cerevisiae
aactttgtta

SEQ ID NO: 5543 - DNA, 10 bp, Saccharomyces cerevisiae
aacttttgcg

SEQ ID NO: 5544 - DNA, 10 bp, Saccharomyces cerevisiae
aactttttct

SEQ ID NO: 5545 - DNA, 10 bp, Saccharomyces cerevisiae
aagaaaaaaa

SEQ ID NO: 5546 - DNA, 10 bp, Saccharomyces cerevisiae
aagaaaaaac

SEQ ID NO: 5547 - DNA, 10 bp, Saccharomyces cerevisiae
aagaaaagtt

SEQ ID NO: 5548 - DNA, 10 bp, Saccharomyces cerevisiae
aagaaacgca

SEQ ID NO: 5549 - DNA, 10 bp, Saccharomyces cerevisiae
aagaaacttt

SEQ ID NO: 5550 - DNA, 10 bp, Saccharomyces cerevisiae
aagaaattat

SEQ ID NO: 5551 - DNA, 10 bp, Saccharomyces cerevisiae
aagaaatttc

SEQ ID NO: 5552 - DNA, 10 bp, Saccharomyces cerevisiae
aagaacaaga

SEQ ID NO: 5553 - DNA, 10 bp, Saccharomyces cerevisiae
aagaactaaa

SEQ ID NO: 5554 - DNA, 10 bp, Saccharomyces cerevisiae
aagaactgga

SEQ ID NO: 5555 - DNA, 10 bp, Saccharomyces cerevisiae
aagaagacag

SEQ ID NO: 5556 - DNA, 10 bp, Saccharomyces cerevisiae
aagaagacct

SEQ ID NO: 5557 - DNA, 10 bp, Saccharomyces cerevisiae
aagaagcaac

SEQ ID NO: 5558 - DNA, 10 bp, Saccharomyces cerevisiae
aagaagcagt

SEQ ID NO: 5559 - DNA, 10 bp, Saccharomyces cerevisiae
aagaagccaa

SEQ ID NO: 5560 - DNA, 10 bp, Saccharomyces cerevisiae
aagaagccat

SEQ ID NO: 5561 - DNA, 10 bp, Saccharomyces cerevisiae
aagaagccgg

SEQ ID NO: 5562 - DNA, 10 bp, Saccharomyces cerevisiae
aagaagcctt

SEQ ID NO: 5563 - DNA, 10 bp, Saccharomyces cerevisiae
aagaagcgac

SEQ ID NO: 5564 - DNA, 10 bp, Saccharomyces cerevisiae
aagaagtaca

SEQ ID NO: 5565 - DNA, 10 bp, Saccharomyces cerevisiae
aagaagtccc

SEQ ID NO: 5566 - DNA, 10 bp, Saccharomyces cerevisiae
aagaagtttg

SEQ ID NO: 5567 - DNA, 10 bp, Saccharomyces cerevisiae
aagaataatt

SEQ ID NO: 5568 - DNA, 10 bp, Saccharomyces cerevisiae
aagaataggc

SEQ ID NO: 5569 - DNA, 10 bp, Saccharomyces cerevisiae
aagaatgtgg

SEQ ID NO: 5570 - DNA, 10 bp, Saccharomyces cerevisiae
aagacaaaaa

SEQ ID NO: 5571 - DNA, 10 bp, Saccharomyces cerevisiae
aagacaaact

SEQ ID NO: 5572 - DNA, 10 bp, Saccharomyces cerevisiae
aagacagagc

SEQ ID NO: 5573 - DNA, 10 bp, Saccharomyces cerevisiae
aagacatacc

SEQ ID NO: 5574 - DNA, 10 bp, Saccharomyces cerevisiae
aagaccaatt

SEQ ID NO: 5575 - DNA, 10 bp, Saccharomyces cerevisiae
aagacgaaaa

SEQ ID NO: 5576 - DNA, 10 bp, Saccharomyces cerevisiae
aagacgatcg

SEQ ID NO: 5577 - DNA, 10 bp, Saccharomyces cerevisiae
aagacgatct

SEQ ID NO: 5578 - DNA, 10 bp, Saccharomyces cerevisiae
aagactcaac

SEQ ID NO: 5579 - DNA, 10 bp, Saccharomyces cerevisiae
aagactctat

SEQ ID NO: 5580 - DNA, 10 bp, Saccharomyces cerevisiae
aagactgtga

SEQ ID NO: 5581 - DNA, 10 bp, Saccharomyces cerevisiae
aagagaaaaa

SEQ ID NO: 5582 - DNA, 10 bp, Saccharomyces cerevisiae
aagagaaggc

SEQ ID NO: 5583 - DNA, 10 bp, Saccharomyces cerevisiae
aagagaaggt

SEQ ID NO: 5584 - DNA, 10 bp, Saccharomyces cerevisiae
aagagacaac

SEQ ID NO: 5585 - DNA, 10 bp, Saccharomyces cerevisiae
aagagaccag

SEQ ID NO: 5586 - DNA, 10 bp, Saccharomyces cerevisiae
aagagatgat

SEQ ID NO: 5587 - DNA, 10 bp, Saccharomyces cerevisiae
aagagcagaa

SEQ ID NO: 5588 - DNA, 10 bp, Saccharomyces cerevisiae
aagagctggt

SEQ ID NO: 5589 - DNA, 10 bp, Saccharomyces cerevisiae
aagaggaaag

SEQ ID NO: 5590 - DNA, 10 bp, Saccharomyces cerevisiae
aagagtgctg

SEQ ID NO: 5591 - DNA, 10 bp, Saccharomyces cerevisiae
aagatatcag

SEQ ID NO: 5592 - DNA, 10 bp, Saccharomyces cerevisiae
aagatcaccg

SEQ ID NO: 5593 - DNA, 10 bp, Saccharomyces cerevisiae
aagatcagaa

SEQ ID NO: 5594 - DNA, 10 bp, Saccharomyces cerevisiae
aagatccaaa

SEQ ID NO: 5595 - DNA, 10 bp, Saccharomyces cerevisiae
aagatgacag

SEQ ID NO: 5596 - DNA, 10 bp, Saccharomyces cerevisiae
aagatgcttt

SEQ ID NO: 5597 - DNA, 10 bp, Saccharomyces cerevisiae
aagatggcca

SEQ ID NO: 5598 - DNA, 10 bp, Saccharomyces cerevisiae
aagattgggt

SEQ ID NO: 5599 - DNA, 10 bp, Saccharomyces cerevisiae
aagattttac

SEQ ID NO: 5600 - DNA, 10 bp, Saccharomyces cerevisiae
aagatttttg

SEQ ID NO: 5601 - DNA, 10 bp, Saccharomyces cerevisiae
aagcaaatag

SEQ ID NO: 5602 - DNA, 10 bp, Saccharomyces cerevisiae
aagcaactaa

SEQ ID NO: 5603 - DNA, 10 bp, Saccharomyces cerevisiae
aagcacatta

SEQ ID NO: 5604 - DNA, 10 bp, Saccharomyces cerevisiae
aagcacctgc

SEQ ID NO: 5605 - DNA, 10 bp, Saccharomyces cerevisiae
aagcacgtca

SEQ ID NO: 5606 - DNA, 10 bp, Saccharomyces cerevisiae
aagcagctca

SEQ ID NO: 5607 - DNA, 10 bp, Saccharomyces cerevisiae
aagcaggtcg

SEQ ID NO: 5608 - DNA, 10 bp, Saccharomyces cerevisiae
aagcataaca

SEQ ID NO: 5609 - DNA, 10 bp, Saccharomyces cerevisiae
aagccagcaa

SEQ ID NO: 5610 - DNA, 10 bp, Saccharomyces cerevisiae
aagccatcac

SEQ ID NO: 5611 - DNA, 10 bp, Saccharomyces cerevisiae
aagccatttt

SEQ ID NO: 5612 - DNA, 10 bp, Saccharomyces cerevisiae
aagcccaaaa

SEQ ID NO: 5613 - DNA, 10 bp, Saccharomyces cerevisiae
aagcccattt

SEQ ID NO: 5614 - DNA, 10 bp, Saccharomyces cerevisiae
aagccggtgc

SEQ ID NO: 5615 - DNA, 10 bp, Saccharomyces cerevisiae
aagcctcctt

SEQ ID NO: 5616 - DNA, 10 bp, Saccharomyces cerevisiae
aagcgaattt

SEQ ID NO: 5617 - DNA, 10 bp, Saccharomyces cerevisiae
aagcgactaa

SEQ ID NO: 5618 - DNA, 10 bp, Saccharomyces cerevisiae
aagcggttgc

SEQ ID NO: 5619 - DNA, 10 bp, Saccharomyces cerevisiae
aagctagatg

SEQ ID NO: 5620 - DNA, 10 bp, Saccharomyces cerevisiae
aagctatgag

SEQ ID NO: 5621 - DNA, 10 bp, Saccharomyces cerevisiae
aagctccgtc

SEQ ID NO: 5622 - DNA, 10 bp, Saccharomyces cerevisiae
aagctgaaca

SEQ ID NO: 5623 - DNA, 10 bp, Saccharomyces cerevisiae
aagctgatgt

SEQ ID NO: 5624 - DNA, 10 bp, Saccharomyces cerevisiae
aagctgctcg

SEQ ID NO: 5625 - DNA, 10 bp, Saccharomyces cerevisiae
aagctggaat

SEQ ID NO: 5626 - DNA, 10 bp, Saccharomyces cerevisiae
aagctttgtc

SEQ ID NO: 5627 - DNA, 10 bp, Saccharomyces cerevisiae
aagcttttgg

SEQ ID NO: 5628 - DNA, 10 bp, Saccharomyces cerevisiae
aaggaactaa

SEQ ID NO: 5629 - DNA, 10 bp, Saccharomyces cerevisiae
aaggaagatg

SEQ ID NO: 5630 - DNA, 10 bp, Saccharomyces cerevisiae
aaggaataag

SEQ ID NO: 5631 - DNA, 10 bp, Saccharomyces cerevisiae
aaggaatcag

SEQ ID NO: 5632 - DNA, 10 bp, Saccharomyces cerevisiae
aaggacaaag

SEQ ID NO: 5633 - DNA, 10 bp, Saccharomyces cerevisiae
aaggaccatc

SEQ ID NO: 5634 - DNA, 10 bp, Saccharomyces cerevisiae
aaggacctaa

SEQ ID NO: 5635 - DNA, 10 bp, Saccharomyces cerevisiae
aaggacgacg

SEQ ID NO: 5636 - DNA, 10 bp, Saccharomyces cerevisiae
aaggactact

SEQ ID NO: 5637 - DNA, 10 bp, Saccharomyces cerevisiae
aaggactgag

SEQ ID NO: 5638 - DNA, 10 bp, Saccharomyces cerevisiae
aaggagaagt

SEQ ID NO: 5639 - DNA, 10 bp, Saccharomyces cerevisiae
aaggagccag

SEQ ID NO: 5640 - DNA, 10 bp, Saccharomyces cerevisiae
aaggaggccc

SEQ ID NO: 5641 - DNA, 10 bp, Saccharomyces cerevisiae
aaggagggct

SEQ ID NO: 5642 - DNA, 10 bp, Saccharomyces cerevisiae
aaggagtctg

SEQ ID NO: 5643 - DNA, 10 bp, Saccharomyces cerevisiae
aaggagtggc

SEQ ID NO: 5644 - DNA, 10 bp, Saccharomyces cerevisiae
aaggataatg

SEQ ID NO: 5645 - DNA, 10 bp, Saccharomyces cerevisiae
aaggatggta

SEQ ID NO: 5646 - DNA, 10 bp, Saccharomyces cerevisiae
aaggcaaatt

SEQ ID NO: 5647 - DNA, 10 bp, Saccharomyces cerevisiae
aaggcaagat

SEQ ID NO: 5648 - DNA, 10 bp, Saccharomyces cerevisiae
aaggccaaga

SEQ ID NO: 5649 - DNA, 10 bp, Saccharomyces cerevisiae
aaggccagcg

SEQ ID NO: 5650 - DNA, 10 bp, Saccharomyces cerevisiae
aaggccaggg

SEQ ID NO: 5651 - DNA, 10 bp, Saccharomyces cerevisiae
aaggccgagc

SEQ ID NO: 5652 - DNA, 10 bp, Saccharomyces cerevisiae
aaggctattt

SEQ ID NO: 5653 - DNA, 10 bp, Saccharomyces cerevisiae
aaggcttttt

SEQ ID NO: 5654 - DNA, 10 bp, Saccharomyces cerevisiae
aagggccaat

SEQ ID NO: 5655 - DNA, 10 bp, Saccharomyces cerevisiae
aaggggtcag

SEQ ID NO: 5656 - DNA, 10 bp, Saccharomyces cerevisiae
aaggggttgg

SEQ ID NO: 5657 - DNA, 10 bp, Saccharomyces cerevisiae
aagggtatca

SEQ ID NO: 5658 - DNA, 10 bp, Saccharomyces cerevisiae
aagggtatcg

SEQ ID NO: 5659 - DNA, 10 bp, Saccharomyces cerevisiae
aaggtacgat

SEQ ID NO: 5660 - DNA, 10 bp, Saccharomyces cerevisiae
aaggtatgga

SEQ ID NO: 5661 - DNA, 10 bp, Saccharomyces cerevisiae
aaggtcaagc

SEQ ID NO: 5662 - DNA, 10 bp, Saccharomyces cerevisiae
aaggtcaagg

SEQ ID NO: 5663 - DNA, 10 bp, Saccharomyces cerevisiae
aaggtcagag

SEQ ID NO: 5664 - DNA, 10 bp, Saccharomyces cerevisiae
aaggtcgaga

SEQ ID NO: 5665 - DNA, 10 bp, Saccharomyces cerevisiae
aaggtcttca

SEQ ID NO: 5666 - DNA, 10 bp, Saccharomyces cerevisiae
aaggtgacaa

SEQ ID NO: 5667 - DNA, 10 bp, Saccharomyces cerevisiae
aaggtgtcaa

SEQ ID NO: 5668 - DNA, 10 bp, Saccharomyces cerevisiae
aaggtgtttt

SEQ ID NO: 5669 - DNA, 10 bp, Saccharomyces cerevisiae
aaggttcccg

SEQ ID NO: 5670 - DNA, 10 bp, Saccharomyces cerevisiae
aaggttgatc

SEQ ID NO: 5671 - DNA, 10 bp, Saccharomyces cerevisiae
aaggttgctc

SEQ ID NO: 5672 - DNA, 10 bp, Saccharomyces cerevisiae
aagtaaatag

SEQ ID NO: 5673 - DNA, 10 bp, Saccharomyces cerevisiae
aagtaactgt

SEQ ID NO: 5674 - DNA, 10 bp, Saccharomyces cerevisiae
aagtacgttg

SEQ ID NO: 5675 - DNA, 10 bp, Saccharomyces cerevisiae
aagtatgacg

SEQ ID NO: 5676 - DNA, 10 bp, Saccharomyces cerevisiae
aagtatgccc

SEQ ID NO: 5677 - DNA, 10 bp, Saccharomyces cerevisiae
aagtatgctc

SEQ ID NO: 5678 - DNA, 10 bp, Saccharomyces cerevisiae
aagtcaaaaa

SEQ ID NO: 5679 - DNA, 10 bp, Saccharomyces cerevisiae
aagtcatagc

SEQ ID NO: 5680 - DNA, 10 bp, Saccharomyces cerevisiae
aagtcgaatg

SEQ ID NO: 5681 - DNA, 10 bp, Saccharomyces cerevisiae
aagtctacgg

SEQ ID NO: 5682 - DNA, 10 bp, Saccharomyces cerevisiae
aagtctctac

SEQ ID NO: 5683 - DNA, 10 bp, Saccharomyces cerevisiae
aagtctgagc

SEQ ID NO: 5684 - DNA, 10 bp, Saccharomyces cerevisiae
aagtctggtg

SEQ ID NO: 5685 - DNA, 10 bp, Saccharomyces cerevisiae
aagtgaactc

SEQ ID NO: 5686 - DNA, 10 bp, Saccharomyces cerevisiae
aagtgagtca

SEQ ID NO: 5687 - DNA, 10 bp, Saccharomyces cerevisiae
aagtgcaaag

SEQ ID NO: 5688 - DNA, 10 bp, Saccharomyces cerevisiae
aagtgcctgt

SEQ ID NO: 5689 - DNA, 10 bp, Saccharomyces cerevisiae
aagtgggcca

SEQ ID NO: 5690 - DNA, 10 bp, Saccharomyces cerevisiae
aagtgtagct

SEQ ID NO: 5691 - DNA, 10 bp, Saccharomyces cerevisiae
aagtgtgata

SEQ ID NO: 5692 - DNA, 10 bp, Saccharomyces cerevisiae
aagtgtgttt

SEQ ID NO: 5693 - DNA, 10 bp, Saccharomyces cerevisiae
aagtgttacc

SEQ ID NO: 5694 - DNA, 10 bp, Saccharomyces cerevisiae
aagttaaaaa

SEQ ID NO: 5695 - DNA, 10 bp, Saccharomyces cerevisiae
aagttagata

SEQ ID NO: 5696 - DNA, 10 bp, Saccharomyces cerevisiae
aagttatgag

SEQ ID NO: 5697 - DNA, 10 bp, Saccharomyces cerevisiae
aagttctcgc

SEQ ID NO: 5698 - DNA, 10 bp, Saccharomyces cerevisiae
aagttgatat

SEQ ID NO: 5699 - DNA, 10 bp, Saccharomyces cerevisiae
aagttgctat

SEQ ID NO: 5700 - DNA, 10 bp, Saccharomyces cerevisiae
aagttgggaa

SEQ ID NO: 5701 - DNA, 10 bp, Saccharomyces cerevisiae
aagtttaatt

SEQ ID NO: 5702 - DNA, 10 bp, Saccharomyces cerevisiae
aagtttatgg

SEQ ID NO: 5703 - DNA, 10 bp, Saccharomyces cerevisiae
aagtttcagc

SEQ ID NO: 5704 - DNA, 10 bp, Saccharomyces cerevisiae
aataaaagaa

SEQ ID NO: 5705 - DNA, 10 bp, Saccharomyces cerevisiae
aataaaagag

SEQ ID NO: 5706 - DNA, 10 bp, Saccharomyces cerevisiae
aataaaatga

SEQ ID NO: 5707 - DNA, 10 bp, Saccharomyces cerevisiae
aataaaatta

SEQ ID NO: 5708 - DNA, 10 bp, Saccharomyces cerevisiae
aataaaccct

SEQ ID NO: 5709 - DNA, 10 bp, Saccharomyces cerevisiae
aataaagaat

SEQ ID NO: 5710 - DNA, 10 bp, Saccharomyces cerevisiae
aataaagtac

SEQ ID NO: 5711 - DNA, 10 bp, Saccharomyces cerevisiae
aataaatacc

SEQ ID NO: 5712 - DNA, 10 bp, Saccharomyces cerevisiae
aataacaaac

SEQ ID NO: 5713 - DNA, 10 bp, Saccharomyces cerevisiae
aataacagtt

SEQ ID NO: 5714 - DNA, 10 bp, Saccharomyces cerevisiae
aataacctta

SEQ ID NO: 5715 - DNA, 10 bp, Saccharomyces cerevisiae
aataagagca

SEQ ID NO: 5716 - DNA, 10 bp, Saccharomyces cerevisiae
aataagcctt

SEQ ID NO: 5717 - DNA, 10 bp, Saccharomyces cerevisiae
aataataaaa

SEQ ID NO: 5718 - DNA, 10 bp, Saccharomyces cerevisiae
aataattagc

SEQ ID NO: 5719 - DNA, 10 bp, Saccharomyces cerevisiae
aatacaaata

SEQ ID NO: 5720 - DNA, 10 bp, Saccharomyces cerevisiae
aatacaagat

SEQ ID NO: 5721 - DNA, 10 bp, Saccharomyces cerevisiae
aatacaaggt

SEQ ID NO: 5722 - DNA, 10 bp, Saccharomyces cerevisiae
aataccatat

SEQ ID NO: 5723 - DNA, 10 bp, Saccharomyces cerevisiae
aatacgttta

SEQ ID NO: 5724 - DNA, 10 bp, Saccharomyces cerevisiae
aatactatca

SEQ ID NO: 5725 - DNA, 10 bp, Saccharomyces cerevisiae
aatagaaagt

SEQ ID NO: 5726 - DNA, 10 bp, Saccharomyces cerevisiae
aatagaccag

SEQ ID NO: 5727 - DNA, 10 bp, Saccharomyces cerevisiae
aatagagata

SEQ ID NO: 5728 - DNA, 10 bp, Saccharomyces cerevisiae
aatagccggc

SEQ ID NO: 5729 - DNA, 10 bp, Saccharomyces cerevisiae
aatagccttg

SEQ ID NO: 5730 - DNA, 10 bp, Saccharomyces cerevisiae
aatagctttt

SEQ ID NO: 5731 - DNA, 10 bp, Saccharomyces cerevisiae
aatagtcaac

SEQ ID NO: 5732 - DNA, 10 bp, Saccharomyces cerevisiae
aatagtgaag

SEQ ID NO: 5733 - DNA, 10 bp, Saccharomyces cerevisiae
aatataaatt

SEQ ID NO: 5734 - DNA, 10 bp, Saccharomyces cerevisiae
aatatcaagc

SEQ ID NO: 5735 - DNA, 10 bp, Saccharomyces cerevisiae
aatatccata

SEQ ID NO: 5736 - DNA, 10 bp, Saccharomyces cerevisiae
aatatgctgt

SEQ ID NO: 5737 - DNA, 10 bp, Saccharomyces cerevisiae
aatattacat

SEQ ID NO: 5738 - DNA, 10 bp, Saccharomyces cerevisiae
aatattcaaa

SEQ ID NO: 5739 - DNA, 10 bp, Saccharomyces cerevisiae
aatattcggg

SEQ ID NO: 5740 - DNA, 10 bp, Saccharomyces cerevisiae
aatattctat

SEQ ID NO: 5741 - DNA, 10 bp, Saccharomyces cerevisiae
aatattctca

SEQ ID NO: 5742 - DNA, 10 bp, Saccharomyces cerevisiae
aatcaaaaac

SEQ ID NO: 5743 - DNA, 10 bp, Saccharomyces cerevisiae
aatcaaattt

SEQ ID NO: 5744 - DNA, 10 bp, Saccharomyces cerevisiae
aatcaacaac

SEQ ID NO: 5745 - DNA, 10 bp, Saccharomyces cerevisiae
aatcaagcat

SEQ ID NO: 5746 - DNA, 10 bp, Saccharomyces cerevisiae
aatcaccctt

SEQ ID NO: 5747 - DNA, 10 bp, Saccharomyces cerevisiae
aatcactggt

SEQ ID NO: 5748 - DNA, 10 bp, Saccharomyces cerevisiae
aatcagtttt

SEQ ID NO: 5749 - DNA, 10 bp, Saccharomyces cerevisiae
aatcataaca

SEQ ID NO: 5750 - DNA, 10 bp, Saccharomyces cerevisiae
aatcatacga

SEQ ID NO: 5751 - DNA, 10 bp, Saccharomyces cerevisiae
aatcatccgt

SEQ ID NO: 5752 - DNA, 10 bp, Saccharomyces cerevisiae
aatccaaaat

SEQ ID NO: 5753 - DNA, 10 bp, Saccharomyces cerevisiae
aatccaaacc

SEQ ID NO: 5754 - DNA, 10 bp, Saccharomyces cerevisiae
aatccaaacg

SEQ ID NO: 5755 - DNA, 10 bp, Saccharomyces cerevisiae
aatccaattg

SEQ ID NO: 5756 - DNA, 10 bp, Saccharomyces cerevisiae
aatccaggtt

SEQ ID NO: 5757 - DNA, 10 bp, Saccharomyces cerevisiae
aatccagtcg

SEQ ID NO: 5758 - DNA, 10 bp, Saccharomyces cerevisiae
aatccagtga

SEQ ID NO: 5759 - DNA, 10 bp, Saccharomyces cerevisiae
aatccagtgg

SEQ ID NO: 5760 - DNA, 10 bp, Saccharomyces cerevisiae
aatccagtta

SEQ ID NO: 5761 - DNA, 10 bp, Saccharomyces cerevisiae
aatccgcaaa

SEQ ID NO: 5762 - DNA, 10 bp, Saccharomyces cerevisiae
aatcctgctt

SEQ ID NO: 5763 - DNA, 10 bp, Saccharomyces cerevisiae
aatcctgtct

SEQ ID NO: 5764 - DNA, 10 bp, Saccharomyces cerevisiae
aatcgaaata

SEQ ID NO: 5765 - DNA, 10 bp, Saccharomyces cerevisiae
aatcgatgac

SEQ ID NO: 5766 - DNA, 10 bp, Saccharomyces cerevisiae
aatcgtcaca

SEQ ID NO: 5767 - DNA, 10 bp, Saccharomyces cerevisiae
aatctaaata

SEQ ID NO: 5768 - DNA, 10 bp, Saccharomyces cerevisiae
aatctagcca

SEQ ID NO: 5769 - DNA, 10 bp, Saccharomyces cerevisiae
aatctatacg

SEQ ID NO: 5770 - DNA, 10 bp, Saccharomyces cerevisiae
aatctattta

SEQ ID NO: 5771 - DNA, 10 bp, Saccharomyces cerevisiae
aatctccagt

SEQ ID NO: 5772 - DNA, 10 bp, Saccharomyces cerevisiae
aatctcttcc

SEQ ID NO: 5773 - DNA, 10 bp, Saccharomyces cerevisiae
aatctggatc

SEQ ID NO: 5774 - DNA, 10 bp, Saccharomyces cerevisiae
aatcttatgg

SEQ ID NO: 5775 - DNA, 10 bp, Saccharomyces cerevisiae
aatcttcgac

SEQ ID NO: 5776 - DNA, 10 bp, Saccharomyces cerevisiae
aatcttgatc

SEQ ID NO: 5777 - DNA, 10 bp, Saccharomyces cerevisiae
aatctttcac

SEQ ID NO: 5778 - DNA, 10 bp, Saccharomyces cerevisiae
aatgaaatgc

SEQ ID NO: 5779 - DNA, 10 bp, Saccharomyces cerevisiae
aatgaaccca

SEQ ID NO: 5780 - DNA, 10 bp, Saccharomyces cerevisiae
aatgaagagc

SEQ ID NO: 5781 - DNA, 10 bp, Saccharomyces cerevisiae
aatgaagtgg

SEQ ID NO: 5782 - DNA, 10 bp, Saccharomyces cerevisiae
aatgaattgc

SEQ ID NO: 5783 - DNA, 10 bp, Saccharomyces cerevisiae
aatgaatttg

SEQ ID NO: 5784 - DNA, 10 bp, Saccharomyces cerevisiae
aatgacgaat

SEQ ID NO: 5785 - DNA, 10 bp, Saccharomyces cerevisiae
aatgacgaca

SEQ ID NO: 5786 - DNA, 10 bp, Saccharomyces cerevisiae
aatgacgcaa

SEQ ID NO: 5787 - DNA, 10 bp, Saccharomyces cerevisiae
aatgacgctc

SEQ ID NO: 5788 - DNA, 10 bp, Saccharomyces cerevisiae
aatgactatc

SEQ ID NO: 5789 - DNA, 10 bp, Saccharomyces cerevisiae
aatgactgta

SEQ ID NO: 5790 - DNA, 10 bp, Saccharomyces cerevisiae
aatgagcacg

SEQ ID NO: 5791 - DNA, 10 bp, Saccharomyces cerevisiae
aatgagtaag

SEQ ID NO: 5792 - DNA, 10 bp, Saccharomyces cerevisiae
aatgataccg

SEQ ID NO: 5793 - DNA, 10 bp, Saccharomyces cerevisiae
aatgatcaat

SEQ ID NO: 5794 - DNA, 10 bp, Saccharomyces cerevisiae
aatgattcat

SEQ ID NO: 5795 - DNA, 10 bp, Saccharomyces cerevisiae
aatgattttt

SEQ ID NO: 5796 - DNA, 10 bp, Saccharomyces cerevisiae
aatgcatttt

SEQ ID NO: 5797 - DNA, 10 bp, Saccharomyces cerevisiae
aatgccgaag

SEQ ID NO: 5798 - DNA, 10 bp, Saccharomyces cerevisiae
aatgcggcaa

SEQ ID NO: 5799 - DNA, 10 bp, Saccharomyces cerevisiae
aatggaaaac

SEQ ID NO: 5800 - DNA, 10 bp, Saccharomyces cerevisiae
aatggacagc

SEQ ID NO: 5801 - DNA, 10 bp, Saccharomyces cerevisiae
aatggagaac

SEQ ID NO: 5802 - DNA, 10 bp, Saccharomyces cerevisiae
aatggccttg

SEQ ID NO: 5803 - DNA, 10 bp, Saccharomyces cerevisiae
aatggcgcac

SEQ ID NO: 5804 - DNA, 10 bp, Saccharomyces cerevisiae
aatggctagc

SEQ ID NO: 5805 - DNA, 10 bp, Saccharomyces cerevisiae
aatgggaagc

SEQ ID NO: 5806 - DNA, 10 bp, Saccharomyces cerevisiae
aatggtaatt

SEQ ID NO: 5807 - DNA, 10 bp, Saccharomyces cerevisiae
aatgtagatc

SEQ ID NO: 5808 - DNA, 10 bp, Saccharomyces cerevisiae
aatgtaggcc

SEQ ID NO: 5809 - DNA, 10 bp, Saccharomyces cerevisiae
aatgtcaaca

SEQ ID NO: 5810 - DNA, 10 bp, Saccharomyces cerevisiae
aatgtcacat

SEQ ID NO: 5811 - DNA, 10 bp, Saccharomyces cerevisiae
aatgtctgat

SEQ ID NO: 5812 - DNA, 10 bp, Saccharomyces cerevisiae
aatgtgaaat

SEQ ID NO: 5813 - DNA, 10 bp, Saccharomyces cerevisiae
aatgtgctaa

SEQ ID NO: 5814 - DNA, 10 bp, Saccharomyces cerevisiae
aatgttactc

SEQ ID NO: 5815 - DNA, 10 bp, Saccharomyces cerevisiae
aatgttctga

SEQ ID NO: 5816 - DNA, 10 bp, Saccharomyces cerevisiae
aatgttgtca

SEQ ID NO: 5817 - DNA, 10 bp, Saccharomyces cerevisiae
aattaagtgg

SEQ ID NO: 5818 - DNA, 10 bp, Saccharomyces cerevisiae
aattacattg

SEQ ID NO: 5819 - DNA, 10 bp, Saccharomyces cerevisiae
aattactaag

SEQ ID NO: 5820 - DNA, 10 bp, Saccharomyces cerevisiae
aattacttcg

SEQ ID NO: 5821 - DNA, 10 bp, Saccharomyces cerevisiae
aattagatag

SEQ ID NO: 5822 - DNA, 10 bp, Saccharomyces cerevisiae
aattatgtga

SEQ ID NO: 5823 - DNA, 10 bp, Saccharomyces cerevisiae
aattattaaa

SEQ ID NO: 5824 - DNA, 10 bp, Saccharomyces cerevisiae
aattattaat

SEQ ID NO: 5825 - DNA, 10 bp, Saccharomyces cerevisiae
aattattgat

SEQ ID NO: 5826 - DNA, 10 bp, Saccharomyces cerevisiae
aattatttag

SEQ ID NO: 5827 - DNA, 10 bp, Saccharomyces cerevisiae
aattattttt

SEQ ID NO: 5828 - DNA, 10 bp, Saccharomyces cerevisiae
aattcaacaa

SEQ ID NO: 5829 - DNA, 10 bp, Saccharomyces cerevisiae
aattcaacct

SEQ ID NO: 5830 - DNA, 10 bp, Saccharomyces cerevisiae
aattcaagca

SEQ ID NO: 5831 - DNA, 10 bp, Saccharomyces cerevisiae
aattccagtt

SEQ ID NO: 5832 - DNA, 10 bp, Saccharomyces cerevisiae
aattcccaaa

SEQ ID NO: 5833 - DNA, 10 bp, Saccharomyces cerevisiae
aattcctgag

SEQ ID NO: 5834 - DNA, 10 bp, Saccharomyces cerevisiae
aattcgagct

SEQ ID NO: 5835 - DNA, 10 bp, Saccharomyces cerevisiae
aattcttcgt

SEQ ID NO: 5836 - DNA, 10 bp, Saccharomyces cerevisiae
aattcttgca

SEQ ID NO: 5837 - DNA, 10 bp, Saccharomyces cerevisiae
aattgaaatt

SEQ ID NO: 5838 - DNA, 10 bp, Saccharomyces cerevisiae
aattgagatc

SEQ ID NO: 5839 - DNA, 10 bp, Saccharomyces cerevisiae
aattgaggca

SEQ ID NO: 5840 - DNA, 10 bp, Saccharomyces cerevisiae
aattgcaata

SEQ ID NO: 5841 - DNA, 10 bp, Saccharomyces cerevisiae
aattgggcag

SEQ ID NO: 5842 - DNA, 10 bp, Saccharomyces cerevisiae
aattggtcac

SEQ ID NO: 5843 - DNA, 10 bp, Saccharomyces cerevisiae
aattgtactt

SEQ ID NO: 5844 - DNA, 10 bp, Saccharomyces cerevisiae
aattgtcgat

SEQ ID NO: 5845 - DNA, 10 bp, Saccharomyces cerevisiae
aattgttaag

SEQ ID NO: 5846 - DNA, 10 bp, Saccharomyces cerevisiae
aatttactga

SEQ ID NO: 5847 - DNA, 10 bp, Saccharomyces cerevisiae
aatttagttc

SEQ ID NO: 5848 - DNA, 10 bp, Saccharomyces cerevisiae
aatttattga

SEQ ID NO: 5849 - DNA, 10 bp, Saccharomyces cerevisiae
aatttcagaa

SEQ ID NO: 5850 - DNA, 10 bp, Saccharomyces cerevisiae
aatttcagca

SEQ ID NO: 5851 - DNA, 10 bp, Saccharomyces cerevisiae
aatttcgaat

SEQ ID NO: 5852 - DNA, 10 bp, Saccharomyces cerevisiae
aatttcgtga

SEQ ID NO: 5853 - DNA, 10 bp, Saccharomyces cerevisiae
aatttctatc

SEQ ID NO: 5854 - DNA, 10 bp, Saccharomyces cerevisiae
aatttggatc

SEQ ID NO: 5855 - DNA, 10 bp, Saccharomyces cerevisiae
aatttggcat

SEQ ID NO: 5856 - DNA, 10 bp, Saccharomyces cerevisiae
aatttgttca

SEQ ID NO: 5857 - DNA, 10 bp, Saccharomyces cerevisiae
aattttccat

SEQ ID NO: 5858 - DNA, 10 bp, Saccharomyces cerevisiae
aattttctcc

SEQ ID NO: 5859 - DNA, 10 bp, Saccharomyces cerevisiae
aattttgccc

SEQ ID NO: 5860 - DNA, 10 bp, Saccharomyces cerevisiae
aatttttaaa

SEQ ID NO: 5861 - DNA, 10 bp, Saccharomyces cerevisiae
aatttttaac

SEQ ID NO: 5862 - DNA, 10 bp, Saccharomyces cerevisiae
aatttttagt

SEQ ID NO: 5863 - DNA, 10 bp, Saccharomyces cerevisiae
aatttttcca

SEQ ID NO: 5864 - DNA, 10 bp, Saccharomyces cerevisiae
acaaaaagag

SEQ ID NO: 5865 - DNA, 10 bp, Saccharomyces cerevisiae
acaaaaattg

SEQ ID NO: 5866 - DNA, 10 bp, Saccharomyces cerevisiae
acaaaaccca

SEQ ID NO: 5867 - DNA, 10 bp, Saccharomyces cerevisiae
acaaaagatt

SEQ ID NO: 5868 - DNA, 10 bp, Saccharomyces cerevisiae
acaaaatcat

SEQ ID NO: 5869 - DNA, 10 bp, Saccharomyces cerevisiae
acaaaattcc

SEQ ID NO: 5870 - DNA, 10 bp, Saccharomyces cerevisiae
acaaaattct

SEQ ID NO: 5871 - DNA, 10 bp, Saccharomyces cerevisiae
acaaactttt

SEQ ID NO: 5872 - DNA, 10 bp, Saccharomyces cerevisiae
acaaagacct

SEQ ID NO: 5873 - DNA, 10 bp, Saccharomyces cerevisiae
acaacaaggt

SEQ ID NO: 5874 - DNA, 10 bp, Saccharomyces cerevisiae
acaacactca

SEQ ID NO: 5875 - DNA, 10 bp, Saccharomyces cerevisiae
acaaccccca

SEQ ID NO: 5876 - DNA, 10 bp, Saccharomyces cerevisiae
acaacgtggt

SEQ ID NO: 5877 - DNA, 10 bp, Saccharomyces cerevisiae
acaagacctt

SEQ ID NO: 5878 - DNA, 10 bp, Saccharomyces cerevisiae
acaagagatc

SEQ ID NO: 5879 - DNA, 10 bp, Saccharomyces cerevisiae
acaagatttg

SEQ ID NO: 5880 - DNA, 10 bp, Saccharomyces cerevisiae
acaagatttt

SEQ ID NO: 5881 - DNA, 10 bp, Saccharomyces cerevisiae
acaagctata

SEQ ID NO: 5882 - DNA, 10 bp, Saccharomyces cerevisiae
acaagtacca

SEQ ID NO: 5883 - DNA, 10 bp, Saccharomyces cerevisiae
acaagtgttt

SEQ ID NO: 5884 - DNA, 10 bp, Saccharomyces cerevisiae
acaagtttga

SEQ ID NO: 5885 - DNA, 10 bp, Saccharomyces cerevisiae
acaataaaca

SEQ ID NO: 5886 - DNA, 10 bp, Saccharomyces cerevisiae
acaataacgc

SEQ ID NO: 5887 - DNA, 10 bp, Saccharomyces cerevisiae
acaatagacc

SEQ ID NO: 5888 - DNA, 10 bp, Saccharomyces cerevisiae
acaatatctg

SEQ ID NO: 5889 - DNA, 10 bp, Saccharomyces cerevisiae
acaatcgatc

SEQ ID NO: 5890 - DNA, 10 bp, Saccharomyces cerevisiae
acaatgaccg

SEQ ID NO: 5891 - DNA, 10 bp, Saccharomyces cerevisiae
acaatgccct

SEQ ID NO: 5892 - DNA, 10 bp, Saccharomyces cerevisiae
acaatgttga

SEQ ID NO: 5893 - DNA, 10 bp, Saccharomyces cerevisiae
acaattaaag

SEQ ID NO: 5894 - DNA, 10 bp, Saccharomyces cerevisiae
acaattcttt

SEQ ID NO: 5895 - DNA, 10 bp, Saccharomyces cerevisiae
acacaaactt

SEQ ID NO: 5896 - DNA, 10 bp, Saccharomyces cerevisiae
acacaccaaa

SEQ ID NO: 5897 - DNA, 10 bp, Saccharomyces cerevisiae
acacaccagc

SEQ ID NO: 5898 - DNA, 10 bp, Saccharomyces cerevisiae
acaccaacaa

SEQ ID NO: 5899 - DNA, 10 bp, Saccharomyces cerevisiae
acaccaacgc

SEQ ID NO: 5900 - DNA, 10 bp, Saccharomyces cerevisiae
acaccagcaa

SEQ ID NO: 5901 - DNA, 10 bp, Saccharomyces cerevisiae
acaccagcct

SEQ ID NO: 5902 - DNA, 10 bp, Saccharomyces cerevisiae
acaccattga

SEQ ID NO: 5903 - DNA, 10 bp, Saccharomyces cerevisiae
acaccatttc

SEQ ID NO: 5904 - DNA, 10 bp, Saccharomyces cerevisiae
acaccctcca

SEQ ID NO: 5905 - DNA, 10 bp, Saccharomyces cerevisiae
acacgatgcc

SEQ ID NO: 5906 - DNA, 10 bp, Saccharomyces cerevisiae
acacgcttgt

SEQ ID NO: 5907 - DNA, 10 bp, Saccharomyces cerevisiae
acacgttcga

SEQ ID NO: 5908 - DNA, 10 bp, Saccharomyces cerevisiae
acactaaatc

SEQ ID NO: 5909 - DNA, 10 bp, Saccharomyces cerevisiae
acactattcc

SEQ ID NO: 5910 - DNA, 10 bp, Saccharomyces cerevisiae
acactcacca

SEQ ID NO: 5911 - DNA, 10 bp, Saccharomyces cerevisiae
acactccatc

SEQ ID NO: 5912 - DNA, 10 bp, Saccharomyces cerevisiae
acactggcgt

SEQ ID NO: 5913 - DNA, 10 bp, Saccharomyces cerevisiae
acacttataa

SEQ ID NO: 5914 - DNA, 10 bp, Saccharomyces cerevisiae
acacttgcct

SEQ ID NO: 5915 - DNA, 10 bp, Saccharomyces cerevisiae
acacttttgt

SEQ ID NO: 5916 - DNA, 10 bp, Saccharomyces cerevisiae
acactttttt

SEQ ID NO: 5917 - DNA, 10 bp, Saccharomyces cerevisiae
acagaaagcc

SEQ ID NO: 5918 - DNA, 10 bp, Saccharomyces cerevisiae
acagaagcga

SEQ ID NO: 5919 - DNA, 10 bp, Saccharomyces cerevisiae
acagaattaa

SEQ ID NO: 5920 - DNA, 10 bp, Saccharomyces cerevisiae
acagaccagg

SEQ ID NO: 5921 - DNA, 10 bp, Saccharomyces cerevisiae
acagagaaaa

SEQ ID NO: 5922 - DNA, 10 bp, Saccharomyces cerevisiae
acagcaattt

SEQ ID NO: 5923 - DNA, 10 bp, Saccharomyces cerevisiae
acagccctct

SEQ ID NO: 5924 - DNA, 10 bp, Saccharomyces cerevisiae
acagctacca

SEQ ID NO: 5925 - DNA, 10 bp, Saccharomyces cerevisiae
acaggatgtc

SEQ ID NO: 5926 - DNA, 10 bp, Saccharomyces cerevisiae
acaggcacct

SEQ ID NO: 5927 - DNA, 10 bp, Saccharomyces cerevisiae
acaggcctga

SEQ ID NO: 5928 - DNA, 10 bp, Saccharomyces cerevisiae
acagggggcg

SEQ ID NO: 5929 - DNA, 10 bp, Saccharomyces cerevisiae
acaggttaca

SEQ ID NO: 5930 - DNA, 10 bp, Saccharomyces cerevisiae
acagtgcgag

SEQ ID NO: 5931 - DNA, 10 bp, Saccharomyces cerevisiae
acagttggga

SEQ ID NO: 5932 - DNA, 10 bp, Saccharomyces cerevisiae
acatacttta

SEQ ID NO: 5933 - DNA, 10 bp, Saccharomyces cerevisiae
acatatgaat

SEQ ID NO: 5934 - DNA, 10 bp, Saccharomyces cerevisiae
acatcaaaaa

SEQ ID NO: 5935 - DNA, 10 bp, Saccharomyces cerevisiae
acatcaagcc

SEQ ID NO: 5936 - DNA, 10 bp, Saccharomyces cerevisiae
acatcagaat

SEQ ID NO: 5937 - DNA, 10 bp, Saccharomyces cerevisiae
acatcatcga

SEQ ID NO: 5938 - DNA, 10 bp, Saccharomyces cerevisiae
acatcatcta

SEQ ID NO: 5939 - DNA, 10 bp, Saccharomyces cerevisiae
acatcattgt

SEQ ID NO: 5940 - DNA, 10 bp, Saccharomyces cerevisiae
acatccacca

SEQ ID NO: 5941 - DNA, 10 bp, Saccharomyces cerevisiae
acatcccgga

SEQ ID NO: 5942 - DNA, 10 bp, Saccharomyces cerevisiae
acatcctcaa

SEQ ID NO: 5943 - DNA, 10 bp, Saccharomyces cerevisiae
acatcgcctg

SEQ ID NO: 5944 - DNA, 10 bp, Saccharomyces cerevisiae
acatcgtttg

SEQ ID NO: 5945 - DNA, 10 bp, Saccharomyces cerevisiae
acatctcgta

SEQ ID NO: 5946 - DNA, 10 bp, Saccharomyces cerevisiae
acatctggtc

SEQ ID NO: 5947 - DNA, 10 bp, Saccharomyces cerevisiae
acattattgg

SEQ ID NO: 5948 - DNA, 10 bp, Saccharomyces cerevisiae
acattccaca

SEQ ID NO: 5949 - DNA, 10 bp, Saccharomyces cerevisiae
acattctttc

SEQ ID NO: 5950 - DNA, 10 bp, Saccharomyces cerevisiae
acattgacga

SEQ ID NO: 5951 - DNA, 10 bp, Saccharomyces cerevisiae
acattgtgta

SEQ ID NO: 5952 - DNA, 10 bp, Saccharomyces cerevisiae
acatttccag

SEQ ID NO: 5953 - DNA, 10 bp, Saccharomyces cerevisiae
acatttctca

SEQ ID NO: 5954 - DNA, 10 bp, Saccharomyces cerevisiae
acatttttat

SEQ ID NO: 5955 - DNA, 10 bp, Saccharomyces cerevisiae
accaaaatgc

SEQ ID NO: 5956 - DNA, 10 bp, Saccharomyces cerevisiae
accaaaattg

SEQ ID NO: 5957 - DNA, 10 bp, Saccharomyces cerevisiae
accaaagaaa

SEQ ID NO: 5958 - DNA, 10 bp, Saccharomyces cerevisiae
accaaattga

SEQ ID NO: 5959 - DNA, 10 bp, Saccharomyces cerevisiae
accaacacat

SEQ ID NO: 5960 - DNA, 10 bp, Saccharomyces cerevisiae
accaagatct

SEQ ID NO: 5961 - DNA, 10 bp, Saccharomyces cerevisiae
accaagcaaa

SEQ ID NO: 5962 - DNA, 10 bp, Saccharomyces cerevisiae
accaaggcta

SEQ ID NO: 5963 - DNA, 10 bp, Saccharomyces cerevisiae
accaagttga

SEQ ID NO: 5964 - DNA, 10 bp, Saccharomyces cerevisiae
accaataaca

SEQ ID NO: 5965 - DNA, 10 bp, Saccharomyces cerevisiae
accaatactc

SEQ ID NO: 5966 - DNA, 10 bp, Saccharomyces cerevisiae
accaatctgc

SEQ ID NO: 5967 - DNA, 10 bp, Saccharomyces cerevisiae
accaattcca

SEQ ID NO: 5968 - DNA, 10 bp, Saccharomyces cerevisiae
accacaatgc

SEQ ID NO: 5969 - DNA, 10 bp, Saccharomyces cerevisiae
accacatcaa

SEQ ID NO: 5970 - DNA, 10 bp, Saccharomyces cerevisiae
accaccagtt

SEQ ID NO: 5971 - DNA, 10 bp, Saccharomyces cerevisiae
accactcctt

SEQ ID NO: 5972 - DNA, 10 bp, Saccharomyces cerevisiae
accactgtgc

SEQ ID NO: 5973 - DNA, 10 bp, Saccharomyces cerevisiae
accagaacca

SEQ ID NO: 5974 - DNA, 10 bp, Saccharomyces cerevisiae
accagaatga

SEQ ID NO: 5975 - DNA, 10 bp, Saccharomyces cerevisiae
accagatctt

SEQ ID NO: 5976 - DNA, 10 bp, Saccharomyces cerevisiae
accagcctcg

SEQ ID NO: 5977 - DNA, 10 bp, Saccharomyces cerevisiae
accaggattg

SEQ ID NO: 5978 - DNA, 10 bp, Saccharomyces cerevisiae
accaggtgtt

SEQ ID NO: 5979 - DNA, 10 bp, Saccharomyces cerevisiae
accatagcgg

SEQ ID NO: 5980 - DNA, 10 bp, Saccharomyces cerevisiae
accatcggtg

SEQ ID NO: 5981 - DNA, 10 bp, Saccharomyces cerevisiae
accatcgtgt

SEQ ID NO: 5982 - DNA, 10 bp, Saccharomyces cerevisiae
accattaaaa

SEQ ID NO: 5983 - DNA, 10 bp, Saccharomyces cerevisiae
accattaaat

SEQ ID NO: 5984 - DNA, 10 bp, Saccharomyces cerevisiae
accattcaag

SEQ ID NO: 5985 - DNA, 10 bp, Saccharomyces cerevisiae
acccaagtga

SEQ ID NO: 5986 - DNA, 10 bp, Saccharomyces cerevisiae
acccaggagt

SEQ ID NO: 5987 - DNA, 10 bp, Saccharomyces cerevisiae
acccatagat

SEQ ID NO: 5988 - DNA, 10 bp, Saccharomyces cerevisiae
accccaaagc

SEQ ID NO: 5989 - DNA, 10 bp, Saccharomyces cerevisiae
accccaaatg

SEQ ID NO: 5990 - DNA, 10 bp, Saccharomyces cerevisiae
accccaacct

SEQ ID NO: 5991 - DNA, 10 bp, Saccharomyces cerevisiae
accccactca

SEQ ID NO: 5992 - DNA, 10 bp, Saccharomyces cerevisiae
accccagaag

SEQ ID NO: 5993 - DNA, 10 bp, Saccharomyces cerevisiae
accccgtcag

SEQ ID NO: 5994 - DNA, 10 bp, Saccharomyces cerevisiae
acccgatgct

SEQ ID NO: 5995 - DNA, 10 bp, Saccharomyces cerevisiae
accctactgc

SEQ ID NO: 5996 - DNA, 10 bp, Saccharomyces cerevisiae
accctatgta

SEQ ID NO: 5997 - DNA, 10 bp, Saccharomyces cerevisiae
accgaactta

SEQ ID NO: 5998 - DNA, 10 bp, Saccharomyces cerevisiae
accgacgctc

SEQ ID NO: 5999 - DNA, 10 bp, Saccharomyces cerevisiae
accgagagat

SEQ ID NO: 6000 - DNA, 10 bp, Saccharomyces cerevisiae
accgagtccg

SEQ ID NO: 6001 - DNA, 10 bp, Saccharomyces cerevisiae
accgatacac

SEQ ID NO: 6002 - DNA, 10 bp, Saccharomyces cerevisiae
accgatggta

SEQ ID NO: 6003 - DNA, 10 bp, Saccharomyces cerevisiae
accgcaagac

SEQ ID NO: 6004 - DNA, 10 bp, Saccharomyces cerevisiae
accgcaatca

SEQ ID NO: 6005 - DNA, 10 bp, Saccharomyces cerevisiae
accgccgctc

SEQ ID NO: 6006 - DNA, 10 bp, Saccharomyces cerevisiae
accgctagtg

SEQ ID NO: 6007 - DNA, 10 bp, Saccharomyces cerevisiae
accgctctgg

SEQ ID NO: 6008 - DNA, 10 bp, Saccharomyces cerevisiae
accgctttct

SEQ ID NO: 6009 - DNA, 10 bp, Saccharomyces cerevisiae
accgggcgct

SEQ ID NO: 6010 - DNA, 10 bp, Saccharomyces cerevisiae
accggtgccc

SEQ ID NO: 6011 - DNA, 10 bp, Saccharomyces cerevisiae
accgtacttt

SEQ ID NO: 6012 - DNA, 10 bp, Saccharomyces cerevisiae
accgtagcgt

SEQ ID NO: 6013 - DNA, 10 bp, Saccharomyces cerevisiae
accgtcaaac

SEQ ID NO: 6014 - DNA, 10 bp, Saccharomyces cerevisiae
accgtcaagt

SEQ ID NO: 6015 - DNA, 10 bp, Saccharomyces cerevisiae
accgtccttc

SEQ ID NO: 6016 - DNA, 10 bp, Saccharomyces cerevisiae
accgtcgaag

SEQ ID NO: 6017 - DNA, 10 bp, Saccharomyces cerevisiae
accgtcgatt

SEQ ID NO: 6018 - DNA, 10 bp, Saccharomyces cerevisiae
accgtggcgt

SEQ ID NO: 6019 - DNA, 10 bp, Saccharomyces cerevisiae
accgttggtg

SEQ ID NO: 6020 - DNA, 10 bp, Saccharomyces cerevisiae
acctaaagaa

SEQ ID NO: 6021 - DNA, 10 bp, Saccharomyces cerevisiae
acctaccttc

SEQ ID NO: 6022 - DNA, 10 bp, Saccharomyces cerevisiae
acctagcata

SEQ ID NO: 6023 - DNA, 10 bp, Saccharomyces cerevisiae
acctataaaa

SEQ ID NO: 6024 - DNA, 10 bp, Saccharomyces cerevisiae
acctattcat

SEQ ID NO: 6025 - DNA, 10 bp, Saccharomyces cerevisiae
acctcaaaaa

SEQ ID NO: 6026 - DNA, 10 bp, Saccharomyces cerevisiae
acctccaagc

SEQ ID NO: 6027 - DNA, 10 bp, Saccharomyces cerevisiae
acctccgttt

SEQ ID NO: 6028 - DNA, 10 bp, Saccharomyces cerevisiae
acctcggctt

SEQ ID NO: 6029 - DNA, 10 bp, Saccharomyces cerevisiae
acctgaatgg

SEQ ID NO: 6030 - DNA, 10 bp, Saccharomyces cerevisiae
acctggataa

SEQ ID NO: 6031 - DNA, 10 bp, Saccharomyces cerevisiae
acctgttgct

SEQ ID NO: 6032 - DNA, 10 bp, Saccharomyces cerevisiae
acctgttggt

SEQ ID NO: 6033 - DNA, 10 bp, Saccharomyces cerevisiae
accttaaaaa

SEQ ID NO: 6034 - DNA, 10 bp, Saccharomyces cerevisiae
accttacatt

SEQ ID NO: 6035 - DNA, 10 bp, Saccharomyces cerevisiae
accttacggg

SEQ ID NO: 6036 - DNA, 10 bp, Saccharomyces cerevisiae
accttcagca

SEQ ID NO: 6037 - DNA, 10 bp, Saccharomyces cerevisiae
accttcattg

SEQ ID NO: 6038 - DNA, 10 bp, Saccharomyces cerevisiae
accttgaaaa

SEQ ID NO: 6039 - DNA, 10 bp, Saccharomyces cerevisiae
accttgaaag

SEQ ID NO: 6040 - DNA, 10 bp, Saccharomyces cerevisiae
accttgggtt

SEQ ID NO: 6041 - DNA, 10 bp, Saccharomyces cerevisiae
accttggtca

SEQ ID NO: 6042 - DNA, 10 bp, Saccharomyces cerevisiae
acctttgcac

SEQ ID NO: 6043 - DNA, 10 bp, Saccharomyces cerevisiae
accttttcat

SEQ ID NO: 6044 - DNA, 10 bp, Saccharomyces cerevisiae
acgaaaattt

SEQ ID NO: 6045 - DNA, 10 bp, Saccharomyces cerevisiae
acgaaagtgg

SEQ ID NO: 6046 - DNA, 10 bp, Saccharomyces cerevisiae
acgaagaaat

SEQ ID NO: 6047 - DNA, 10 bp, Saccharomyces cerevisiae
acgaagcgct

SEQ ID NO: 6048 - DNA, 10 bp, Saccharomyces cerevisiae
acgaagctag

SEQ ID NO: 6049 - DNA, 10 bp, Saccharomyces cerevisiae
acgaagctca

SEQ ID NO: 6050 - DNA, 10 bp, Saccharomyces cerevisiae
acgaagctgg

SEQ ID NO: 6051 - DNA, 10 bp, Saccharomyces cerevisiae
acgaaggatt

SEQ ID NO: 6052 - DNA, 10 bp, Saccharomyces cerevisiae
acgaagtgag

SEQ ID NO: 6053 - DNA, 10 bp, Saccharomyces cerevisiae
acgaagttgt

SEQ ID NO: 6054 - DNA, 10 bp, Saccharomyces cerevisiae
acgaatcaca

SEQ ID NO: 6055 - DNA, 10 bp, Saccharomyces cerevisiae
acgaatgagg

SEQ ID NO: 6056 - DNA, 10 bp, Saccharomyces cerevisiae
acgaatgctg

SEQ ID NO: 6057 - DNA, 10 bp, Saccharomyces cerevisiae
acgaattata

SEQ ID NO: 6058 - DNA, 10 bp, Saccharomyces cerevisiae
acgaattgtt

SEQ ID NO: 6059 - DNA, 10 bp, Saccharomyces cerevisiae
acgacaactc

SEQ ID NO: 6060 - DNA, 10 bp, Saccharomyces cerevisiae
acgacagtaa

SEQ ID NO: 6061 - DNA, 10 bp, Saccharomyces cerevisiae
acgacgatga

SEQ ID NO: 6062 - DNA, 10 bp, Saccharomyces cerevisiae
acgagctccg

SEQ ID NO: 6063 - DNA, 10 bp, Saccharomyces cerevisiae
acgaggaaaa

SEQ ID NO: 6064 - DNA, 10 bp, Saccharomyces cerevisiae
acgaggatag

SEQ ID NO: 6065 - DNA, 10 bp, Saccharomyces cerevisiae
acgataaatc

SEQ ID NO: 6066 - DNA, 10 bp, Saccharomyces cerevisiae
acgatatcgt

SEQ ID NO: 6067 - DNA, 10 bp, Saccharomyces cerevisiae
acgatgaaag

SEQ ID NO: 6068 - DNA, 10 bp, Saccharomyces cerevisiae
acgatgaagg

SEQ ID NO: 6069 - DNA, 10 bp, Saccharomyces cerevisiae
acgatgcttt

SEQ ID NO: 6070 - DNA, 10 bp, Saccharomyces cerevisiae
acgattcgcc

SEQ ID NO: 6071 - DNA, 10 bp, Saccharomyces cerevisiae
acgcaatgga

SEQ ID NO: 6072 - DNA, 10 bp, Saccharomyces cerevisiae
acgcagattt

SEQ ID NO: 6073 - DNA, 10 bp, Saccharomyces cerevisiae
acgcatatta

SEQ ID NO: 6074 - DNA, 10 bp, Saccharomyces cerevisiae
acgcattgtc

SEQ ID NO: 6075 - DNA, 10 bp, Saccharomyces cerevisiae
acgccagctc

SEQ ID NO: 6076 - DNA, 10 bp, Saccharomyces cerevisiae
acgccgctca

SEQ ID NO: 6077 - DNA, 10 bp, Saccharomyces cerevisiae
acgcctgtgt

SEQ ID NO: 6078 - DNA, 10 bp, Saccharomyces cerevisiae
acgcgaatct

SEQ ID NO: 6079 - DNA, 10 bp, Saccharomyces cerevisiae
acgctctttt

SEQ ID NO: 6080 - DNA, 10 bp, Saccharomyces cerevisiae
acggaacaaa

SEQ ID NO: 6081 - DNA, 10 bp, Saccharomyces cerevisiae
acggaagact

SEQ ID NO: 6082 - DNA, 10 bp, Saccharomyces cerevisiae
acggaagccc

SEQ ID NO: 6083 - DNA, 10 bp, Saccharomyces cerevisiae
acggacatag

SEQ ID NO: 6084 - DNA, 10 bp, Saccharomyces cerevisiae
acggagttga

SEQ ID NO: 6085 - DNA, 10 bp, Saccharomyces cerevisiae
acggatatta

SEQ ID NO: 6086 - DNA, 10 bp, Saccharomyces cerevisiae
acggcaaact

SEQ ID NO: 6087 - DNA, 10 bp, Saccharomyces cerevisiae
acggcagaga

SEQ ID NO: 6088 - DNA, 10 bp, Saccharomyces cerevisiae
acggcagcaa

SEQ ID NO: 6089 - DNA, 10 bp, Saccharomyces cerevisiae
acggccaagt

SEQ ID NO: 6090 - DNA, 10 bp, Saccharomyces cerevisiae
acggccttac

SEQ ID NO: 6091 - DNA, 10 bp, Saccharomyces cerevisiae
acggctctca

SEQ ID NO: 6092 - DNA, 10 bp, Saccharomyces cerevisiae
acgggtcgcc

SEQ ID NO: 6093 - DNA, 10 bp, Saccharomyces cerevisiae
acgggttatg

SEQ ID NO: 6094 - DNA, 10 bp, Saccharomyces cerevisiae
acggtaatca

SEQ ID NO: 6095 - DNA, 10 bp, Saccharomyces cerevisiae
acggtatatt

SEQ ID NO: 6096 - DNA, 10 bp, Saccharomyces cerevisiae
acggtcaata

SEQ ID NO: 6097 - DNA, 10 bp, Saccharomyces cerevisiae
acgtacgttt

SEQ ID NO: 6098 - DNA, 10 bp, Saccharomyces cerevisiae
acgtatatac

SEQ ID NO: 6099 - DNA, 10 bp, Saccharomyces cerevisiae
acgtatttcg

SEQ ID NO: 6100 - DNA, 10 bp, Saccharomyces cerevisiae
acgtcctttt

SEQ ID NO: 6101 - DNA, 10 bp, Saccharomyces cerevisiae
acgtcgcagc

SEQ ID NO: 6102 - DNA, 10 bp, Saccharomyces cerevisiae
acgtctcata

SEQ ID NO: 6103 - DNA, 10 bp, Saccharomyces cerevisiae
acgtctttca

SEQ ID NO: 6104 - DNA, 10 bp, Saccharomyces cerevisiae
acgtgacttg

SEQ ID NO: 6105 - DNA, 10 bp, Saccharomyces cerevisiae
acgtgtgtaa

SEQ ID NO: 6106 - DNA, 10 bp, Saccharomyces cerevisiae
acgtgttaat

SEQ ID NO: 6107 - DNA, 10 bp, Saccharomyces cerevisiae
acgttatcac

SEQ ID NO: 6108 - DNA, 10 bp, Saccharomyces cerevisiae
acgttccgtt

SEQ ID NO: 6109 - DNA, 10 bp, Saccharomyces cerevisiae
acgttcctca

SEQ ID NO: 6110 - DNA, 10 bp, Saccharomyces cerevisiae
acgttccttt

SEQ ID NO: 6111 - DNA, 10 bp, Saccharomyces cerevisiae
acgttcttgt

SEQ ID NO: 6112 - DNA, 10 bp, Saccharomyces cerevisiae
acgttctttc

SEQ ID NO: 6113 - DNA, 10 bp, Saccharomyces cerevisiae
actaaaacta

SEQ ID NO: 6114 - DNA, 10 bp, Saccharomyces cerevisiae
actaaacccc

SEQ ID NO: 6115 - DNA, 10 bp, Saccharomyces cerevisiae
actaaactgg

SEQ ID NO: 6116 - DNA, 10 bp, Saccharomyces cerevisiae
actaaatcaa

SEQ ID NO: 6117 - DNA, 10 bp, Saccharomyces cerevisiae
actaaatcac

SEQ ID NO: 6118 - DNA, 10 bp, Saccharomyces cerevisiae
actaaatgac

SEQ ID NO: 6119 - DNA, 10 bp, Saccharomyces cerevisiae
actaactttg

SEQ ID NO: 6120 - DNA, 10 bp, Saccharomyces cerevisiae
actaagatga

SEQ ID NO: 6121 - DNA, 10 bp, Saccharomyces cerevisiae
actaaggaga

SEQ ID NO: 6122 - DNA, 10 bp, Saccharomyces cerevisiae
actaattcaa

SEQ ID NO: 6123 - DNA, 10 bp, Saccharomyces cerevisiae
actacaacag

SEQ ID NO: 6124 - DNA, 10 bp, Saccharomyces cerevisiae
actacaattt

SEQ ID NO: 6125 - DNA, 10 bp, Saccharomyces cerevisiae
actacctgaa

SEQ ID NO: 6126 - DNA, 10 bp, Saccharomyces cerevisiae
actactgaaa

SEQ ID NO: 6127 - DNA, 10 bp, Saccharomyces cerevisiae
actactggta

SEQ ID NO: 6128 - DNA, 10 bp, Saccharomyces cerevisiae
actagaaatt

SEQ ID NO: 6129 - DNA, 10 bp, Saccharomyces cerevisiae
actagaatct

SEQ ID NO: 6130 - DNA, 10 bp, Saccharomyces cerevisiae
actagaattg

SEQ ID NO: 6131 - DNA, 10 bp, Saccharomyces cerevisiae
actaggattt

SEQ ID NO: 6132 - DNA, 10 bp, Saccharomyces cerevisiae
actagtagta

SEQ ID NO: 6133 - DNA, 10 bp, Saccharomyces cerevisiae
actatcgagg

SEQ ID NO: 6134 - DNA, 10 bp, Saccharomyces cerevisiae
actatgaata

SEQ ID NO: 6135 - DNA, 10 bp, Saccharomyces cerevisiae
actattatga

SEQ ID NO: 6136 - DNA, 10 bp, Saccharomyces cerevisiae
actattatgg

SEQ ID NO: 6137 - DNA, 10 bp, Saccharomyces cerevisiae
actcaatact

SEQ ID NO: 6138 - DNA, 10 bp, Saccharomyces cerevisiae
actcacttca

SEQ ID NO: 6139 - DNA, 10 bp, Saccharomyces cerevisiae
actcagaaag

SEQ ID NO: 6140 - DNA, 10 bp, Saccharomyces cerevisiae
actcagattc

SEQ ID NO: 6141 - DNA, 10 bp, Saccharomyces cerevisiae
actcagtttc

SEQ ID NO: 6142 - DNA, 10 bp, Saccharomyces cerevisiae
actccattaa

SEQ ID NO: 6143 - DNA, 10 bp, Saccharomyces cerevisiae
actccattga

SEQ ID NO: 6144 - DNA, 10 bp, Saccharomyces cerevisiae
actcctacat

SEQ ID NO: 6145 - DNA, 10 bp, Saccharomyces cerevisiae
actcgagttg

SEQ ID NO: 6146 - DNA, 10 bp, Saccharomyces cerevisiae
actcgattac

SEQ ID NO: 6147 - DNA, 10 bp, Saccharomyces cerevisiae
actcgcattt

SEQ ID NO: 6148 - DNA, 10 bp, Saccharomyces cerevisiae
actcgtcccc

SEQ ID NO: 6149 - DNA, 10 bp, Saccharomyces cerevisiae
actctaactt

SEQ ID NO: 6150 - DNA, 10 bp, Saccharomyces cerevisiae
actctactgg

SEQ ID NO: 6151 - DNA, 10 bp, Saccharomyces cerevisiae
actctatcgg

SEQ ID NO: 6152 - DNA, 10 bp, Saccharomyces cerevisiae
actctcatta

SEQ ID NO: 6153 - DNA, 10 bp, Saccharomyces cerevisiae
actctcttga

SEQ ID NO: 6154 - DNA, 10 bp, Saccharomyces cerevisiae
actcttgtaa

SEQ ID NO: 6155 - DNA, 10 bp, Saccharomyces cerevisiae
actctttcat

SEQ ID NO: 6156 - DNA, 10 bp, Saccharomyces cerevisiae
actgaaacga

SEQ ID NO: 6157 - DNA, 10 bp, Saccharomyces cerevisiae
actgaacgta

SEQ ID NO: 6158 - DNA, 10 bp, Saccharomyces cerevisiae
actgactaag

SEQ ID NO: 6159 - DNA, 10 bp, Saccharomyces cerevisiae
actgagtttt

SEQ ID NO: 6160 - DNA, 10 bp, Saccharomyces cerevisiae
actgatagat

SEQ ID NO: 6161 - DNA, 10 bp, Saccharomyces cerevisiae
actgatatat

SEQ ID NO: 6162 - DNA, 10 bp, Saccharomyces cerevisiae
actgatgatg

SEQ ID NO: 6163 - DNA, 10 bp, Saccharomyces cerevisiae
actgcactaa

SEQ ID NO: 6164 - DNA, 10 bp, Saccharomyces cerevisiae
actgcagaca

SEQ ID NO: 6165 - DNA, 10 bp, Saccharomyces cerevisiae
actgcattag

SEQ ID NO: 6166 - DNA, 10 bp, Saccharomyces cerevisiae
actgcatttg

SEQ ID NO: 6167 - DNA, 10 bp, Saccharomyces cerevisiae
actgcctaat

SEQ ID NO: 6168 - DNA, 10 bp, Saccharomyces cerevisiae
actgccttac

SEQ ID NO: 6169 - DNA, 10 bp, Saccharomyces cerevisiae
actgctagac

SEQ ID NO: 6170 - DNA, 10 bp, Saccharomyces cerevisiae
actgctattc

SEQ ID NO: 6171 - DNA, 10 bp, Saccharomyces cerevisiae
actgctgcct

SEQ ID NO: 6172 - DNA, 10 bp, Saccharomyces cerevisiae
actgcttcaa

SEQ ID NO: 6173 - DNA, 10 bp, Saccharomyces cerevisiae
actggaaacc

SEQ ID NO: 6174 - DNA, 10 bp, Saccharomyces cerevisiae
actggctaaa

SEQ ID NO: 6175 - DNA, 10 bp, Saccharomyces cerevisiae
actggggcag

SEQ ID NO: 6176 - DNA, 10 bp, Saccharomyces cerevisiae
actggtattg

SEQ ID NO: 6177 - DNA, 10 bp, Saccharomyces cerevisiae
actggtcaat

SEQ ID NO: 6178 - DNA, 10 bp, Saccharomyces cerevisiae
actggttttg

SEQ ID NO: 6179 - DNA, 10 bp, Saccharomyces cerevisiae
actgtacgtt

SEQ ID NO: 6180 - DNA, 10 bp, Saccharomyces cerevisiae
actgtactct

SEQ ID NO: 6181 - DNA, 10 bp, Saccharomyces cerevisiae
actgtccatt

SEQ ID NO: 6182 - DNA, 10 bp, Saccharomyces cerevisiae
actgtcgctg

SEQ ID NO: 6183 - DNA, 10 bp, Saccharomyces cerevisiae
actgtgaaac

SEQ ID NO: 6184 - DNA, 10 bp, Saccharomyces cerevisiae
actgtgaaat

SEQ ID NO: 6185 - DNA, 10 bp, Saccharomyces cerevisiae
actgtgctga

SEQ ID NO: 6186 - DNA, 10 bp, Saccharomyces cerevisiae
actgtgggtt

SEQ ID NO: 6187 - DNA, 10 bp, Saccharomyces cerevisiae
actgtttcag

SEQ ID NO: 6188 - DNA, 10 bp, Saccharomyces cerevisiae
acttaacaat

SEQ ID NO: 6189 - DNA, 10 bp, Saccharomyces cerevisiae
acttacaaaa

SEQ ID NO: 6190 - DNA, 10 bp, Saccharomyces cerevisiae
acttacaacc

SEQ ID NO: 6191 - DNA, 10 bp, Saccharomyces cerevisiae
acttacccct

SEQ ID NO: 6192 - DNA, 10 bp, Saccharomyces cerevisiae
acttactcgt

SEQ ID NO: 6193 - DNA, 10 bp, Saccharomyces cerevisiae
acttagtatt

SEQ ID NO: 6194 - DNA, 10 bp, Saccharomyces cerevisiae
acttagtttg

SEQ ID NO: 6195 - DNA, 10 bp, Saccharomyces cerevisiae
acttatgatt

SEQ ID NO: 6196 - DNA, 10 bp, Saccharomyces cerevisiae
acttattttt

SEQ ID NO: 6197 - DNA, 10 bp, Saccharomyces cerevisiae
acttcaaatg

SEQ ID NO: 6198 - DNA, 10 bp, Saccharomyces cerevisiae
acttcaacta

SEQ ID NO: 6199 - DNA, 10 bp, Saccharomyces cerevisiae
acttcaattc

SEQ ID NO: 6200 - DNA, 10 bp, Saccharomyces cerevisiae
acttcacgtt

SEQ ID NO: 6201 - DNA, 10 bp, Saccharomyces cerevisiae
acttcagaaa

SEQ ID NO: 6202 - DNA, 10 bp, Saccharomyces cerevisiae
acttcagcag

SEQ ID NO: 6203 - DNA, 10 bp, Saccharomyces cerevisiae
acttcagcgt

SEQ ID NO: 6204 - DNA, 10 bp, Saccharomyces cerevisiae
acttcattac

SEQ ID NO: 6205 - DNA, 10 bp, Saccharomyces cerevisiae
acttccacgt

SEQ ID NO: 6206 - DNA, 10 bp, Saccharomyces cerevisiae
acttcccgca

SEQ ID NO: 6207 - DNA, 10 bp, Saccharomyces cerevisiae
acttccggtg

SEQ ID NO: 6208 - DNA, 10 bp, Saccharomyces cerevisiae
acttcgttcg

SEQ ID NO: 6209 - DNA, 10 bp, Saccharomyces cerevisiae
acttctggac

SEQ ID NO: 6210 - DNA, 10 bp, Saccharomyces cerevisiae
acttcttgag

SEQ ID NO: 6211 - DNA, 10 bp, Saccharomyces cerevisiae
acttcttggt

SEQ ID NO: 6212 - DNA, 10 bp, Saccharomyces cerevisiae
acttgaacgt

SEQ ID NO: 6213 - DNA, 10 bp, Saccharomyces cerevisiae
acttgacaag

SEQ ID NO: 6214 - DNA, 10 bp, Saccharomyces cerevisiae
acttgactgt

SEQ ID NO: 6215 - DNA, 10 bp, Saccharomyces cerevisiae
acttgcaata

SEQ ID NO: 6216 - DNA, 10 bp, Saccharomyces cerevisiae
acttggaaaa

SEQ ID NO: 6217 - DNA, 10 bp, Saccharomyces cerevisiae
acttggatct

SEQ ID NO: 6218 - DNA, 10 bp, Saccharomyces cerevisiae
acttgtgtaa

SEQ ID NO: 6219 - DNA, 10 bp, Saccharomyces cerevisiae
acttgttgat

SEQ ID NO: 6220 - DNA, 10 bp, Saccharomyces cerevisiae
actttaaaga

SEQ ID NO: 6221 - DNA, 10 bp, Saccharomyces cerevisiae
actttaaatc

SEQ ID NO: 6222 - DNA, 10 bp, Saccharomyces cerevisiae
actttaatat

SEQ ID NO: 6223 - DNA, 10 bp, Saccharomyces cerevisiae
actttatttc

SEQ ID NO: 6224 - DNA, 10 bp, Saccharomyces cerevisiae
actttcttcg

SEQ ID NO: 6225 - DNA, 10 bp, Saccharomyces cerevisiae
actttgattg

SEQ ID NO: 6226 - DNA, 10 bp, Saccharomyces cerevisiae
actttggcta

SEQ ID NO: 6227 - DNA, 10 bp, Saccharomyces cerevisiae
acttttaatc

SEQ ID NO: 6228 - DNA, 10 bp, Saccharomyces cerevisiae
acttttagaa

SEQ ID NO: 6229 - DNA, 10 bp, Saccharomyces cerevisiae
acttttcagt

SEQ ID NO: 6230 - DNA, 10 bp, Saccharomyces cerevisiae
acttttgaat

SEQ ID NO: 6231 - DNA, 10 bp, Saccharomyces cerevisiae
acttttttgg

SEQ ID NO: 6232 - DNA, 10 bp, Saccharomyces cerevisiae
acttttttta

SEQ ID NO: 6233 - DNA, 10 bp, Saccharomyces cerevisiae
agaaaaaaag

SEQ ID NO: 6234 - DNA, 10 bp, Saccharomyces cerevisiae
agaaaaaacc

SEQ ID NO: 6235 - DNA, 10 bp, Saccharomyces cerevisiae
agaaaaaaga

SEQ ID NO: 6236 - DNA, 10 bp, Saccharomyces cerevisiae
agaaaaaatg

SEQ ID NO: 6237 - DNA, 10 bp, Saccharomyces cerevisiae
agaaaaactg

SEQ ID NO: 6238 - DNA, 10 bp, Saccharomyces cerevisiae
agaaaaatag

SEQ ID NO: 6239 - DNA, 10 bp, Saccharomyces cerevisiae
agaaaaatgt

SEQ ID NO: 6240 - DNA, 10 bp, Saccharomyces cerevisiae
agaaaacgag

SEQ ID NO: 6241 - DNA, 10 bp, Saccharomyces cerevisiae
agaaaagatg

SEQ ID NO: 6242 - DNA, 10 bp, Saccharomyces cerevisiae
agaaaagtgt

SEQ ID NO: 6243 - DNA, 10 bp, Saccharomyces cerevisiae
agaaacttaa

SEQ ID NO: 6244 - DNA, 10 bp, Saccharomyces cerevisiae
agaaacttct

SEQ ID NO: 6245 - DNA, 10 bp, Saccharomyces cerevisiae
agaaagtaag

SEQ ID NO: 6246 - DNA, 10 bp, Saccharomyces cerevisiae
agaaatgctg

SEQ ID NO: 6247 - DNA, 10 bp, Saccharomyces cerevisiae
agaaatgtgt

SEQ ID NO: 6248 - DNA, 10 bp, Saccharomyces cerevisiae
agaacaaact

SEQ ID NO: 6249 - DNA, 10 bp, Saccharomyces cerevisiae
agaacatcca

SEQ ID NO: 6250 - DNA, 10 bp, Saccharomyces cerevisiae
agaacctcac

SEQ ID NO: 6251 - DNA, 10 bp, Saccharomyces cerevisiae
agaacctttc

SEQ ID NO: 6252 - DNA, 10 bp, Saccharomyces cerevisiae
agaactggac

SEQ ID NO: 6253 - DNA, 10 bp, Saccharomyces cerevisiae
agaacttgaa

SEQ ID NO: 6254 - DNA, 10 bp, Saccharomyces cerevisiae
agaacttgat

SEQ ID NO: 6255 - DNA, 10 bp, Saccharomyces cerevisiae
agaagaacgg

SEQ ID NO: 6256 - DNA, 10 bp, Saccharomyces cerevisiae
agaagaagag

SEQ ID NO: 6257 - DNA, 10 bp, Saccharomyces cerevisiae
agaagacaag

SEQ ID NO: 6258 - DNA, 10 bp, Saccharomyces cerevisiae
agaagagata

SEQ ID NO: 6259 - DNA, 10 bp, Saccharomyces cerevisiae
agaagagcac

SEQ ID NO: 6260 - DNA, 10 bp, Saccharomyces cerevisiae
agaagaggcg

SEQ ID NO: 6261 - DNA, 10 bp, Saccharomyces cerevisiae
agaagaggtg

SEQ ID NO: 6262 - DNA, 10 bp, Saccharomyces cerevisiae
agaagatgga

SEQ ID NO: 6263 - DNA, 10 bp, Saccharomyces cerevisiae
agaagcacaa

SEQ ID NO: 6264 - DNA, 10 bp, Saccharomyces cerevisiae
agaagcaccc

SEQ ID NO: 6265 - DNA, 10 bp, Saccharomyces cerevisiae
agaagcactg

SEQ ID NO: 6266 - DNA, 10 bp, Saccharomyces cerevisiae
agaagccaga

SEQ ID NO: 6267 - DNA, 10 bp, Saccharomyces cerevisiae
agaagccagt

SEQ ID NO: 6268 - DNA, 10 bp, Saccharomyces cerevisiae
agaagccgtt

SEQ ID NO: 6269 - DNA, 10 bp, Saccharomyces cerevisiae
agaaggaccc

SEQ ID NO: 6270 - DNA, 10 bp, Saccharomyces cerevisiae
agaaggcata

SEQ ID NO: 6271 - DNA, 10 bp, Saccharomyces cerevisiae
agaaggctcc

SEQ ID NO: 6272 - DNA, 10 bp, Saccharomyces cerevisiae
agaagggaaa

SEQ ID NO: 6273 - DNA, 10 bp, Saccharomyces cerevisiae
agaagtcaaa

SEQ ID NO: 6274 - DNA, 10 bp, Saccharomyces cerevisiae
agaagtgggt

SEQ ID NO: 6275 - DNA, 10 bp, Saccharomyces cerevisiae
agaagtgtat

SEQ ID NO: 6276 - DNA, 10 bp, Saccharomyces cerevisiae
agaataatgg

SEQ ID NO: 6277 - DNA, 10 bp, Saccharomyces cerevisiae
agaatacatt

SEQ ID NO: 6278 - DNA, 10 bp, Saccharomyces cerevisiae
agaataccgt

SEQ ID NO: 6279 - DNA, 10 bp, Saccharomyces cerevisiae
agaatatggt

SEQ ID NO: 6280 - DNA, 10 bp, Saccharomyces cerevisiae
agaatcacgt

SEQ ID NO: 6281 - DNA, 10 bp, Saccharomyces cerevisiae
agaattagta

SEQ ID NO: 6282 - DNA, 10 bp, Saccharomyces cerevisiae
agaattcaaa

SEQ ID NO: 6283 - DNA, 10 bp, Saccharomyces cerevisiae
agaattcaga

SEQ ID NO: 6284 - DNA, 10 bp, Saccharomyces cerevisiae
agaattcata

SEQ ID NO: 6285 - DNA, 10 bp, Saccharomyces cerevisiae
agaattgctc

SEQ ID NO: 6286 - DNA, 10 bp, Saccharomyces cerevisiae
agaattgtta

SEQ ID NO: 6287 - DNA, 10 bp, Saccharomyces cerevisiae
agacaaaccc

SEQ ID NO: 6288 - DNA, 10 bp, Saccharomyces cerevisiae
agacaaactt

SEQ ID NO: 6289 - DNA, 10 bp, Saccharomyces cerevisiae
agacaaattg

SEQ ID NO: 6290 - DNA, 10 bp, Saccharomyces cerevisiae
agacaaccga

SEQ ID NO: 6291 - DNA, 10 bp, Saccharomyces cerevisiae
agacaacctg

SEQ ID NO: 6292 - DNA, 10 bp, Saccharomyces cerevisiae
agacaattgg

SEQ ID NO: 6293 - DNA, 10 bp, Saccharomyces cerevisiae
agacacactg

SEQ ID NO: 6294 - DNA, 10 bp, Saccharomyces cerevisiae
agacacgaag

SEQ ID NO: 6295 - DNA, 10 bp, Saccharomyces cerevisiae
agacatactg

SEQ ID NO: 6296 - DNA, 10 bp, Saccharomyces cerevisiae
agaccaaact

SEQ ID NO: 6297 - DNA, 10 bp, Saccharomyces cerevisiae
agaccaagcc

SEQ ID NO: 6298 - DNA, 10 bp, Saccharomyces cerevisiae
agaccaatcc

SEQ ID NO: 6299 - DNA, 10 bp, Saccharomyces cerevisiae
agaccactcc

SEQ ID NO: 6300 - DNA, 10 bp, Saccharomyces cerevisiae
agaccagaaa

SEQ ID NO: 6301 - DNA, 10 bp, Saccharomyces cerevisiae
agaccattcc

SEQ ID NO: 6302 - DNA, 10 bp, Saccharomyces cerevisiae
agaccattga

SEQ ID NO: 6303 - DNA, 10 bp, Saccharomyces cerevisiae
agaccattgg

SEQ ID NO: 6304 - DNA, 10 bp, Saccharomyces cerevisiae
agaccattgt

SEQ ID NO: 6305 - DNA, 10 bp, Saccharomyces cerevisiae
agacccattt

SEQ ID NO: 6306 - DNA, 10 bp, Saccharomyces cerevisiae
agacgacatt

SEQ ID NO: 6307 - DNA, 10 bp, Saccharomyces cerevisiae
agacgatgtc

SEQ ID NO: 6308 - DNA, 10 bp, Saccharomyces cerevisiae
agacgcccgc

SEQ ID NO: 6309 - DNA, 10 bp, Saccharomyces cerevisiae
agactaactg

SEQ ID NO: 6310 - DNA, 10 bp, Saccharomyces cerevisiae
agactacgga

SEQ ID NO: 6311 - DNA, 10 bp, Saccharomyces cerevisiae
agactgccac

SEQ ID NO: 6312 - DNA, 10 bp, Saccharomyces cerevisiae
agacttagta

SEQ ID NO: 6313 - DNA, 10 bp, Saccharomyces cerevisiae
agagaacaag

SEQ ID NO: 6314 - DNA, 10 bp, Saccharomyces cerevisiae
agagaagtgg

SEQ ID NO: 6315 - DNA, 10 bp, Saccharomyces cerevisiae
agagaatacc

SEQ ID NO: 6316 - DNA, 10 bp, Saccharomyces cerevisiae
agagaatgcg

SEQ ID NO: 6317 - DNA, 10 bp, Saccharomyces cerevisiae
agagacagag

SEQ ID NO: 6318 - DNA, 10 bp, Saccharomyces cerevisiae
agagacggca

SEQ ID NO: 6319 - DNA, 10 bp, Saccharomyces cerevisiae
agagagaatg

SEQ ID NO: 6320 - DNA, 10 bp, Saccharomyces cerevisiae
agagagatcg

SEQ ID NO: 6321 - DNA, 10 bp, Saccharomyces cerevisiae
agagagctac

SEQ ID NO: 6322 - DNA, 10 bp, Saccharomyces cerevisiae
agagagggaa

SEQ ID NO: 6323 - DNA, 10 bp, Saccharomyces cerevisiae
agagatgaat

SEQ ID NO: 6324 - DNA, 10 bp, Saccharomyces cerevisiae
agagcagaag

SEQ ID NO: 6325 - DNA, 10 bp, Saccharomyces cerevisiae
agagctataa

SEQ ID NO: 6326 - DNA, 10 bp, Saccharomyces cerevisiae
agagcttggg

SEQ ID NO: 6327 - DNA, 10 bp, Saccharomyces cerevisiae
agaggaactg

SEQ ID NO: 6328 - DNA, 10 bp, Saccharomyces cerevisiae
agaggaataa

SEQ ID NO: 6329 - DNA, 10 bp, Saccharomyces cerevisiae
agaggagcac

SEQ ID NO: 6330 - DNA, 10 bp, Saccharomyces cerevisiae
agaggatact

SEQ ID NO: 6331 - DNA, 10 bp, Saccharomyces cerevisiae
agaggctgga

SEQ ID NO: 6332 - DNA, 10 bp, Saccharomyces cerevisiae
agaggctttt

SEQ ID NO: 6333 - DNA, 10 bp, Saccharomyces cerevisiae
agagggccta

SEQ ID NO: 6334 - DNA, 10 bp, Saccharomyces cerevisiae
agagggtgat

SEQ ID NO: 6335 - DNA, 10 bp, Saccharomyces cerevisiae
agaggtgatc

SEQ ID NO: 6336 - DNA, 10 bp, Saccharomyces cerevisiae
agagtagcaa

SEQ ID NO: 6337 - DNA, 10 bp, Saccharomyces cerevisiae
agagtcttga

SEQ ID NO: 6338 - DNA, 10 bp, Saccharomyces cerevisiae
agagtgcaag

SEQ ID NO: 6339 - DNA, 10 bp, Saccharomyces cerevisiae
agagtgttca

SEQ ID NO: 6340 - DNA, 10 bp, Saccharomyces cerevisiae
agataaactg

SEQ ID NO: 6341 - DNA, 10 bp, Saccharomyces cerevisiae
agataaattc

SEQ ID NO: 6342 - DNA, 10 bp, Saccharomyces cerevisiae
agataagttt

SEQ ID NO: 6343 - DNA, 10 bp, Saccharomyces cerevisiae
agatagcaaa

SEQ ID NO: 6344 - DNA, 10 bp, Saccharomyces cerevisiae
agatagcgaa

SEQ ID NO: 6345 - DNA, 10 bp, Saccharomyces cerevisiae
agatagtaag

SEQ ID NO: 6346 - DNA, 10 bp, Saccharomyces cerevisiae
agatcaaaaa

SEQ ID NO: 6347 - DNA, 10 bp, Saccharomyces cerevisiae
agatcctcat

SEQ ID NO: 6348 - DNA, 10 bp, Saccharomyces cerevisiae
agatgaaact

SEQ ID NO: 6349 - DNA, 10 bp, Saccharomyces cerevisiae
agatgaattt

SEQ ID NO: 6350 - DNA, 10 bp, Saccharomyces cerevisiae
agatgacttc

SEQ ID NO: 6351 - DNA, 10 bp, Saccharomyces cerevisiae
agatgatcgt

SEQ ID NO: 6352 - DNA, 10 bp, Saccharomyces cerevisiae
agatgatgaa

SEQ ID NO: 6353 - DNA, 10 bp, Saccharomyces cerevisiae
agatgcaaaa

SEQ ID NO: 6354 - DNA, 10 bp, Saccharomyces cerevisiae
agatggactt

SEQ ID NO: 6355 - DNA, 10 bp, Saccharomyces cerevisiae
agatggatcc

SEQ ID NO: 6356 - DNA, 10 bp, Saccharomyces cerevisiae
agatgtgcaa

SEQ ID NO: 6357 - DNA, 10 bp, Saccharomyces cerevisiae
agatgttatc

SEQ ID NO: 6358 - DNA, 10 bp, Saccharomyces cerevisiae
agattaagaa

SEQ ID NO: 6359 - DNA, 10 bp, Saccharomyces cerevisiae
agattacaaa

SEQ ID NO: 6360 - DNA, 10 bp, Saccharomyces cerevisiae
agattacgac

SEQ ID NO: 6361 - DNA, 10 bp, Saccharomyces cerevisiae
agattcaaag

SEQ ID NO: 6362 - DNA, 10 bp, Saccharomyces cerevisiae
agattctgcg

SEQ ID NO: 6363 - DNA, 10 bp, Saccharomyces cerevisiae
agattgactc

SEQ ID NO: 6364 - DNA, 10 bp, Saccharomyces cerevisiae
agattgccca

SEQ ID NO: 6365 - DNA, 10 bp, Saccharomyces cerevisiae
agattggatg

SEQ ID NO: 6366 - DNA, 10 bp, Saccharomyces cerevisiae
agattgtatt

SEQ ID NO: 6367 - DNA, 10 bp, Saccharomyces cerevisiae
agatttgatg

SEQ ID NO: 6368 - DNA, 10 bp, Saccharomyces cerevisiae
agattttttt

SEQ ID NO: 6369 - DNA, 10 bp, Saccharomyces cerevisiae
agcaaaaaga

SEQ ID NO: 6370 - DNA, 10 bp, Saccharomyces cerevisiae
agcaaactgc

SEQ ID NO: 6371 - DNA, 10 bp, Saccharomyces cerevisiae
agcaaccagc

SEQ ID NO: 6372 - DNA, 10 bp, Saccharomyces cerevisiae
agcaacgaag

SEQ ID NO: 6373 - DNA, 10 bp, Saccharomyces cerevisiae
agcaataaaa

SEQ ID NO: 6374 - DNA, 10 bp, Saccharomyces cerevisiae
agcaatggaa

SEQ ID NO: 6375 - DNA, 10 bp, Saccharomyces cerevisiae
agcaatgtgg

SEQ ID NO: 6376 - DNA, 10 bp, Saccharomyces cerevisiae
agcaccatag

SEQ ID NO: 6377 - DNA, 10 bp, Saccharomyces cerevisiae
agcacggtgt

SEQ ID NO: 6378 - DNA, 10 bp, Saccharomyces cerevisiae
agcactgaag

SEQ ID NO: 6379 - DNA, 10 bp, Saccharomyces cerevisiae
agcactggtg

SEQ ID NO: 6380 - DNA, 10 bp, Saccharomyces cerevisiae
agcagattga

SEQ ID NO: 6381 - DNA, 10 bp, Saccharomyces cerevisiae
agcagcacaa

SEQ ID NO: 6382 - DNA, 10 bp, Saccharomyces cerevisiae
agcagctcag

SEQ ID NO: 6383 - DNA, 10 bp, Saccharomyces cerevisiae
agcaggaaca

SEQ ID NO: 6384 - DNA, 10 bp, Saccharomyces cerevisiae
agcagtatgc

SEQ ID NO: 6385 - DNA, 10 bp, Saccharomyces cerevisiae
agcagtgaag

SEQ ID NO: 6386 - DNA, 10 bp, Saccharomyces cerevisiae
agcagtggcc

SEQ ID NO: 6387 - DNA, 10 bp, Saccharomyces cerevisiae
agcagttcac

SEQ ID NO: 6388 - DNA, 10 bp, Saccharomyces cerevisiae
agcagtttct

SEQ ID NO: 6389 - DNA, 10 bp, Saccharomyces cerevisiae
agcataaaag

SEQ ID NO: 6390 - DNA, 10 bp, Saccharomyces cerevisiae
agcataaaga

SEQ ID NO: 6391 - DNA, 10 bp, Saccharomyces cerevisiae
agcatacaag

SEQ ID NO: 6392 - DNA, 10 bp, Saccharomyces cerevisiae
agcatcaagc

SEQ ID NO: 6393 - DNA, 10 bp, Saccharomyces cerevisiae
agcattacca

SEQ ID NO: 6394 - DNA, 10 bp, Saccharomyces cerevisiae
agcattagat

SEQ ID NO: 6395 - DNA, 10 bp, Saccharomyces cerevisiae
agcatttgat

SEQ ID NO: 6396 - DNA, 10 bp, Saccharomyces cerevisiae
agcatttgcc

SEQ ID NO: 6397 - DNA, 10 bp, Saccharomyces cerevisiae
agcatttttg

SEQ ID NO: 6398 - DNA, 10 bp, Saccharomyces cerevisiae
agccaaaaac

SEQ ID NO: 6399 - DNA, 10 bp, Saccharomyces cerevisiae
agccaaactg

SEQ ID NO: 6400 - DNA, 10 bp, Saccharomyces cerevisiae
agccaattcg

SEQ ID NO: 6401 - DNA, 10 bp, Saccharomyces cerevisiae
agccagatca

SEQ ID NO: 6402 - DNA, 10 bp, Saccharomyces cerevisiae
agccatctgt

SEQ ID NO: 6403 - DNA, 10 bp, Saccharomyces cerevisiae
agccattaac

SEQ ID NO: 6404 - DNA, 10 bp, Saccharomyces cerevisiae
agccattgct

SEQ ID NO: 6405 - DNA, 10 bp, Saccharomyces cerevisiae
agccattttg

SEQ ID NO: 6406 - DNA, 10 bp, Saccharomyces cerevisiae
agcccaaact

SEQ ID NO: 6407 - DNA, 10 bp, Saccharomyces cerevisiae
agcccagctc

SEQ ID NO: 6408 - DNA, 10 bp, Saccharomyces cerevisiae
agcccgattc

SEQ ID NO: 6409 - DNA, 10 bp, Saccharomyces cerevisiae
agccctctta

SEQ ID NO: 6410 - DNA, 10 bp, Saccharomyces cerevisiae
agccgagatc

SEQ ID NO: 6411 - DNA, 10 bp, Saccharomyces cerevisiae
agcctaagtt

SEQ ID NO: 6412 - DNA, 10 bp, Saccharomyces cerevisiae
agcctattga

SEQ ID NO: 6413 - DNA, 10 bp, Saccharomyces cerevisiae
agcgaatgtg

SEQ ID NO: 6414 - DNA, 10 bp, Saccharomyces cerevisiae
agcgactgac

SEQ ID NO: 6415 - DNA, 10 bp, Saccharomyces cerevisiae
agcgccattg

SEQ ID NO: 6416 - DNA, 10 bp, Saccharomyces cerevisiae
agcgctttaa

SEQ ID NO: 6417 - DNA, 10 bp, Saccharomyces cerevisiae
agcggatgtt

SEQ ID NO: 6418 - DNA, 10 bp, Saccharomyces cerevisiae
agcggattga

SEQ ID NO: 6419 - DNA, 10 bp, Saccharomyces cerevisiae
agcgggtctt

SEQ ID NO: 6420 - DNA, 10 bp, Saccharomyces cerevisiae
agcgggtgct

SEQ ID NO: 6421 - DNA, 10 bp, Saccharomyces cerevisiae
agcggtgtta

SEQ ID NO: 6422 - DNA, 10 bp, Saccharomyces cerevisiae
agcgtattag

SEQ ID NO: 6423 - DNA, 10 bp, Saccharomyces cerevisiae
agcgtcaaat

SEQ ID NO: 6424 - DNA, 10 bp, Saccharomyces cerevisiae
agcgtgacgt

SEQ ID NO: 6425 - DNA, 10 bp, Saccharomyces cerevisiae
agctaaaaca

SEQ ID NO: 6426 - DNA, 10 bp, Saccharomyces cerevisiae
agctaaactg

SEQ ID NO: 6427 - DNA, 10 bp, Saccharomyces cerevisiae
agctaaatag

SEQ ID NO: 6428 - DNA, 10 bp, Saccharomyces cerevisiae
agctaacatt

SEQ ID NO: 6429 - DNA, 10 bp, Saccharomyces cerevisiae
agctagaacg

SEQ ID NO: 6430 - DNA, 10 bp, Saccharomyces cerevisiae
agctaggcat

SEQ ID NO: 6431 - DNA, 10 bp, Saccharomyces cerevisiae
agctataaac

SEQ ID NO: 6432 - DNA, 10 bp, Saccharomyces cerevisiae
agctatgatg

SEQ ID NO: 6433 - DNA, 10 bp, Saccharomyces cerevisiae
agctccgcca

SEQ ID NO: 6434 - DNA, 10 bp, Saccharomyces cerevisiae
agctcggcat

SEQ ID NO: 6435 - DNA, 10 bp, Saccharomyces cerevisiae
agctgaaaac

SEQ ID NO: 6436 - DNA, 10 bp, Saccharomyces cerevisiae
agctgaacta

SEQ ID NO: 6437 - DNA, 10 bp, Saccharomyces cerevisiae
agctgagatt

SEQ ID NO: 6438 - DNA, 10 bp, Saccharomyces cerevisiae
agctgtgctg

SEQ ID NO: 6439 - DNA, 10 bp, Saccharomyces cerevisiae
agcttggcgt

SEQ ID NO: 6440 - DNA, 10 bp, Saccharomyces cerevisiae
agctttagcc

SEQ ID NO: 6441 - DNA, 10 bp, Saccharomyces cerevisiae
agcttttact

SEQ ID NO: 6442 - DNA, 10 bp, Saccharomyces cerevisiae
aggaaaaaac

SEQ ID NO: 6443 - DNA, 10 bp, Saccharomyces cerevisiae
aggaaaatgt

SEQ ID NO: 6444 - DNA, 10 bp, Saccharomyces cerevisiae
aggaaacaag

SEQ ID NO: 6445 - DNA, 10 bp, Saccharomyces cerevisiae
aggaaagaac

SEQ ID NO: 6446 - DNA, 10 bp, Saccharomyces cerevisiae
aggaacgact

SEQ ID NO: 6447 - DNA, 10 bp, Saccharomyces cerevisiae
aggaacggtt

SEQ ID NO: 6448 - DNA, 10 bp, Saccharomyces cerevisiae
aggaacttaa

SEQ ID NO: 6449 - DNA, 10 bp, Saccharomyces cerevisiae
aggaagatga

SEQ ID NO: 6450 - DNA, 10 bp, Saccharomyces cerevisiae
aggaagatgt

SEQ ID NO: 6451 - DNA, 10 bp, Saccharomyces cerevisiae
aggaagttct

SEQ ID NO: 6452 - DNA, 10 bp, Saccharomyces cerevisiae
aggaatcttg

SEQ ID NO: 6453 - DNA, 10 bp, Saccharomyces cerevisiae
aggaatgggt

SEQ ID NO: 6454 - DNA, 10 bp, Saccharomyces cerevisiae
aggacaaatc

SEQ ID NO: 6455 - DNA, 10 bp, Saccharomyces cerevisiae
aggacacatc

SEQ ID NO: 6456 - DNA, 10 bp, Saccharomyces cerevisiae
aggacattgg

SEQ ID NO: 6457 - DNA, 10 bp, Saccharomyces cerevisiae
aggaccatcc

SEQ ID NO: 6458 - DNA, 10 bp, Saccharomyces cerevisiae
aggaccgtct

SEQ ID NO: 6459 - DNA, 10 bp, Saccharomyces cerevisiae
aggacggcgg

SEQ ID NO: 6460 - DNA, 10 bp, Saccharomyces cerevisiae
aggacgtcga

SEQ ID NO: 6461 - DNA, 10 bp, Saccharomyces cerevisiae
aggacgtgaa

SEQ ID NO: 6462 - DNA, 10 bp, Saccharomyces cerevisiae
aggactgtta

SEQ ID NO: 6463 - DNA, 10 bp, Saccharomyces cerevisiae
aggagaacaa

SEQ ID NO: 6464 - DNA, 10 bp, Saccharomyces cerevisiae
aggagacggt

SEQ ID NO: 6465 - DNA, 10 bp, Saccharomyces cerevisiae
aggagccaga

SEQ ID NO: 6466 - DNA, 10 bp, Saccharomyces cerevisiae
aggagcggtt

SEQ ID NO: 6467 - DNA, 10 bp, Saccharomyces cerevisiae
aggaggatat

SEQ ID NO: 6468 - DNA, 10 bp, Saccharomyces cerevisiae
aggaggctag

SEQ ID NO: 6469 - DNA, 10 bp, Saccharomyces cerevisiae
aggagttcca

SEQ ID NO: 6470 - DNA, 10 bp, Saccharomyces cerevisiae
aggagttctg

SEQ ID NO: 6471 - DNA, 10 bp, Saccharomyces cerevisiae
aggagttttt

SEQ ID NO: 6472 - DNA, 10 bp, Saccharomyces cerevisiae
aggatcttag

SEQ ID NO: 6473 - DNA, 10 bp, Saccharomyces cerevisiae
aggatcttga

SEQ ID NO: 6474 - DNA, 10 bp, Saccharomyces cerevisiae
aggatgaagc

SEQ ID NO: 6475 - DNA, 10 bp, Saccharomyces cerevisiae
aggcaaacca

SEQ ID NO: 6476 - DNA, 10 bp, Saccharomyces cerevisiae
aggcaaatga

SEQ ID NO: 6477 - DNA, 10 bp, Saccharomyces cerevisiae
aggcagaacc

SEQ ID NO: 6478 - DNA, 10 bp, Saccharomyces cerevisiae
aggcaggcca

SEQ ID NO: 6479 - DNA, 10 bp, Saccharomyces cerevisiae
aggcagtcag

SEQ ID NO: 6480 - DNA, 10 bp, Saccharomyces cerevisiae
aggccaactg

SEQ ID NO: 6481 - DNA, 10 bp, Saccharomyces cerevisiae
aggccattgc

SEQ ID NO: 6482 - DNA, 10 bp, Saccharomyces cerevisiae
aggccatttg

SEQ ID NO: 6483 - DNA, 10 bp, Saccharomyces cerevisiae
aggcctgaaa

SEQ ID NO: 6484 - DNA, 10 bp, Saccharomyces cerevisiae
aggctctgct

SEQ ID NO: 6485 - DNA, 10 bp, Saccharomyces cerevisiae
aggcttgaga

SEQ ID NO: 6486 - DNA, 10 bp, Saccharomyces cerevisiae
aggcttgagg

SEQ ID NO: 6487 - DNA, 10 bp, Saccharomyces cerevisiae
agggacatcg

SEQ ID NO: 6488 - DNA, 10 bp, Saccharomyces cerevisiae
agggatacca

SEQ ID NO: 6489 - DNA, 10 bp, Saccharomyces cerevisiae
agggatgctg

SEQ ID NO: 6490 - DNA, 10 bp, Saccharomyces cerevisiae
agggcaggaa

SEQ ID NO: 6491 - DNA, 10 bp, Saccharomyces cerevisiae
agggcagttt

SEQ ID NO: 6492 - DNA, 10 bp, Saccharomyces cerevisiae
agggccacct

SEQ ID NO: 6493 - DNA, 10 bp, Saccharomyces cerevisiae
agggccataa

SEQ ID NO: 6494 - DNA, 10 bp, Saccharomyces cerevisiae
agggcttggt

SEQ ID NO: 6495 - DNA, 10 bp, Saccharomyces cerevisiae
aggggaaaag

SEQ ID NO: 6496 - DNA, 10 bp, Saccharomyces cerevisiae
aggggaagaa

SEQ ID NO: 6497 - DNA, 10 bp, Saccharomyces cerevisiae
aggggcacgt

SEQ ID NO: 6498 - DNA, 10 bp, Saccharomyces cerevisiae
aggggggaac

SEQ ID NO: 6499 - DNA, 10 bp, Saccharomyces cerevisiae
agggtagaag

SEQ ID NO: 6500 - DNA, 10 bp, Saccharomyces cerevisiae
agggtcatcc

SEQ ID NO: 6501 - DNA, 10 bp, Saccharomyces cerevisiae
agggtttata

SEQ ID NO: 6502 - DNA, 10 bp, Saccharomyces cerevisiae
agggtttgag

SEQ ID NO: 6503 - DNA, 10 bp, Saccharomyces cerevisiae
aggtaactgc

SEQ ID NO: 6504 - DNA, 10 bp, Saccharomyces cerevisiae
aggtacattt

SEQ ID NO: 6505 - DNA, 10 bp, Saccharomyces cerevisiae
aggtagttag

SEQ ID NO: 6506 - DNA, 10 bp, Saccharomyces cerevisiae
aggtatgatg

SEQ ID NO: 6507 - DNA, 10 bp, Saccharomyces cerevisiae
aggtgaaacg

SEQ ID NO: 6508 - DNA, 10 bp, Saccharomyces cerevisiae
aggtgagaga

SEQ ID NO: 6509 - DNA, 10 bp, Saccharomyces cerevisiae
aggtgcccaa

SEQ ID NO: 6510 - DNA, 10 bp, Saccharomyces cerevisiae
aggtgtaaga

SEQ ID NO: 6511 - DNA, 10 bp, Saccharomyces cerevisiae
aggttaagat

SEQ ID NO: 6512 - DNA, 10 bp, Saccharomyces cerevisiae
aggttatgtg

SEQ ID NO: 6513 - DNA, 10 bp, Saccharomyces cerevisiae
aggttattgt

SEQ ID NO: 6514 - DNA, 10 bp, Saccharomyces cerevisiae
aggttgccac

SEQ ID NO: 6515 - DNA, 10 bp, Saccharomyces cerevisiae
aggttgtgtg

SEQ ID NO: 6516 - DNA, 10 bp, Saccharomyces cerevisiae
aggtttcggt

SEQ ID NO: 6517 - DNA, 10 bp, Saccharomyces cerevisiae
agtaaaaacg

SEQ ID NO: 6518 - DNA, 10 bp, Saccharomyces cerevisiae
agtaaacccg

SEQ ID NO: 6519 - DNA, 10 bp, Saccharomyces cerevisiae
agtaacgatg

SEQ ID NO: 6520 - DNA, 10 bp, Saccharomyces cerevisiae
agtaatcacg

SEQ ID NO: 6521 - DNA, 10 bp, Saccharomyces cerevisiae
agtaattctc

SEQ ID NO: 6522 - DNA, 10 bp, Saccharomyces cerevisiae
agtactacaa

SEQ ID NO: 6523 - DNA, 10 bp, Saccharomyces cerevisiae
agtactagtt

SEQ ID NO: 6524 - DNA, 10 bp, Saccharomyces cerevisiae
agtactgaag

SEQ ID NO: 6525 - DNA, 10 bp, Saccharomyces cerevisiae
agtagagccg

SEQ ID NO: 6526 - DNA, 10 bp, Saccharomyces cerevisiae
agtagccaac

SEQ ID NO: 6527 - DNA, 10 bp, Saccharomyces cerevisiae
agtaggttaa

SEQ ID NO: 6528 - DNA, 10 bp, Saccharomyces cerevisiae
agtatagtgg

SEQ ID NO: 6529 - DNA, 10 bp, Saccharomyces cerevisiae
agtatatata

SEQ ID NO: 6530 - DNA, 10 bp, Saccharomyces cerevisiae
agtatatgca

SEQ ID NO: 6531 - DNA, 10 bp, Saccharomyces cerevisiae
agtatcacac

SEQ ID NO: 6532 - DNA, 10 bp, Saccharomyces cerevisiae
agtatgatca

SEQ ID NO: 6533 - DNA, 10 bp, Saccharomyces cerevisiae
agtatgggtg

SEQ ID NO: 6534 - DNA, 10 bp, Saccharomyces cerevisiae
agtattatca

SEQ ID NO: 6535 - DNA, 10 bp, Saccharomyces cerevisiae
agtcaaactg

SEQ ID NO: 6536 - DNA, 10 bp, Saccharomyces cerevisiae
agtcaactct

SEQ ID NO: 6537 - DNA, 10 bp, Saccharomyces cerevisiae
agtccagctt

SEQ ID NO: 6538 - DNA, 10 bp, Saccharomyces cerevisiae
agtccctgtt

SEQ ID NO: 6539 - DNA, 10 bp, Saccharomyces cerevisiae
agtccgatta

SEQ ID NO: 6540 - DNA, 10 bp, Saccharomyces cerevisiae
agtccgccaa

SEQ ID NO: 6541 - DNA, 10 bp, Saccharomyces cerevisiae
agtcctcctt

SEQ ID NO: 6542 - DNA, 10 bp, Saccharomyces cerevisiae
agtcgtactg

SEQ ID NO: 6543 - DNA, 10 bp, Saccharomyces cerevisiae
agtcttcttc

SEQ ID NO: 6544 - DNA, 10 bp, Saccharomyces cerevisiae
agtcttcttt

SEQ ID NO: 6545 - DNA, 10 bp, Saccharomyces cerevisiae
agtgaaggtg

SEQ ID NO: 6546 - DNA, 10 bp, Saccharomyces cerevisiae
agtgaatttc

SEQ ID NO: 6547 - DNA, 10 bp, Saccharomyces cerevisiae
agtgagacca

SEQ ID NO: 6548 - DNA, 10 bp, Saccharomyces cerevisiae
agtgatatgg

SEQ ID NO: 6549 - DNA, 10 bp, Saccharomyces cerevisiae
agtgatccat

SEQ ID NO: 6550 - DNA, 10 bp, Saccharomyces cerevisiae
agtgccataa

SEQ ID NO: 6551 - DNA, 10 bp, Saccharomyces cerevisiae
agtgcgtata

SEQ ID NO: 6552 - DNA, 10 bp, Saccharomyces cerevisiae
agtgctgaaa

SEQ ID NO: 6553 - DNA, 10 bp, Saccharomyces cerevisiae
agtgctgttt

SEQ ID NO: 6554 - DNA, 10 bp, Saccharomyces cerevisiae
agtggaaaaa

SEQ ID NO: 6555 - DNA, 10 bp, Saccharomyces cerevisiae
agtggaagga

SEQ ID NO: 6556 - DNA, 10 bp, Saccharomyces cerevisiae
agtggacata

SEQ ID NO: 6557 - DNA, 10 bp, Saccharomyces cerevisiae
agtggatagc

SEQ ID NO: 6558 - DNA, 10 bp, Saccharomyces cerevisiae
agtggctcaa

SEQ ID NO: 6559 - DNA, 10 bp, Saccharomyces cerevisiae
agtgggctga

SEQ ID NO: 6560 - DNA, 10 bp, Saccharomyces cerevisiae
agtggggccg

SEQ ID NO: 6561 - DNA, 10 bp, Saccharomyces cerevisiae
agtggtagaa

SEQ ID NO: 6562 - DNA, 10 bp, Saccharomyces cerevisiae
agtgtatttc

SEQ ID NO: 6563 - DNA, 10 bp, Saccharomyces cerevisiae
agtgtcagtt

SEQ ID NO: 6564 - DNA, 10 bp, Saccharomyces cerevisiae
agtgttgctt

SEQ ID NO: 6565 - DNA, 10 bp, Saccharomyces cerevisiae
agtgtttata

SEQ ID NO: 6566 - DNA, 10 bp, Saccharomyces cerevisiae
agttaagagt

SEQ ID NO: 6567 - DNA, 10 bp, Saccharomyces cerevisiae
agttactgtt

SEQ ID NO: 6568 - DNA, 10 bp, Saccharomyces cerevisiae
agttatcaaa

SEQ ID NO: 6569 - DNA, 10 bp, Saccharomyces cerevisiae
agttatccaa

SEQ ID NO: 6570 - DNA, 10 bp, Saccharomyces cerevisiae
agttcaatgc

SEQ ID NO: 6571 - DNA, 10 bp, Saccharomyces cerevisiae
agttcacact

SEQ ID NO: 6572 - DNA, 10 bp, Saccharomyces cerevisiae
agttcccggt

SEQ ID NO: 6573 - DNA, 10 bp, Saccharomyces cerevisiae
agttcgaaga

SEQ ID NO: 6574 - DNA, 10 bp, Saccharomyces cerevisiae
agttcgggag

SEQ ID NO: 6575 - DNA, 10 bp, Saccharomyces cerevisiae
agttctccag

SEQ ID NO: 6576 - DNA, 10 bp, Saccharomyces cerevisiae
agttctcttt

SEQ ID NO: 6577 - DNA, 10 bp, Saccharomyces cerevisiae
agttcttata

SEQ ID NO: 6578 - DNA, 10 bp, Saccharomyces cerevisiae
agttcttcac

SEQ ID NO: 6579 - DNA, 10 bp, Saccharomyces cerevisiae
agttgaaatt

SEQ ID NO: 6580 - DNA, 10 bp, Saccharomyces cerevisiae
agttgagtta

SEQ ID NO: 6581 - DNA, 10 bp, Saccharomyces cerevisiae
agtttaccac

SEQ ID NO: 6582 - DNA, 10 bp, Saccharomyces cerevisiae
agtttacctc

SEQ ID NO: 6583 - DNA, 10 bp, Saccharomyces cerevisiae
agtttataaa

SEQ ID NO: 6584 - DNA, 10 bp, Saccharomyces cerevisiae
agtttcctga

SEQ ID NO: 6585 - DNA, 10 bp, Saccharomyces cerevisiae
agtttgatga

SEQ ID NO: 6586 - DNA, 10 bp, Saccharomyces cerevisiae
agtttggaga

SEQ ID NO: 6587 - DNA, 10 bp, Saccharomyces cerevisiae
agtttggcaa

SEQ ID NO: 6588 - DNA, 10 bp, Saccharomyces cerevisiae
agttttattt

SEQ ID NO: 6589 - DNA, 10 bp, Saccharomyces cerevisiae
agttttcctt

SEQ ID NO: 6590 - DNA, 10 bp, Saccharomyces cerevisiae
agttttctgc

SEQ ID NO: 6591 - DNA, 10 bp, Saccharomyces cerevisiae
agttttgcat

SEQ ID NO: 6592 - DNA, 10 bp, Saccharomyces cerevisiae
agttttggtt

SEQ ID NO: 6593 - DNA, 10 bp, Saccharomyces cerevisiae
agttttttga

SEQ ID NO: 6594 - DNA, 10 bp, Saccharomyces cerevisiae
ataaaaaaag

SEQ ID NO: 6595 - DNA, 10 bp, Saccharomyces cerevisiae
ataaaaaggg

SEQ ID NO: 6596 - DNA, 10 bp, Saccharomyces cerevisiae
ataaaaatga

SEQ ID NO: 6597 - DNA, 10 bp, Saccharomyces cerevisiae
ataaaagaag

SEQ ID NO: 6598 - DNA, 10 bp, Saccharomyces cerevisiae
ataaaagtaa

SEQ ID NO: 6599 - DNA, 10 bp, Saccharomyces cerevisiae
ataaaagtgt

SEQ ID NO: 6600 - DNA, 10 bp, Saccharomyces cerevisiae
ataaagaaaa

SEQ ID NO: 6601 - DNA, 10 bp, Saccharomyces cerevisiae
ataaagaaag

SEQ ID NO: 6602 - DNA, 10 bp, Saccharomyces cerevisiae
ataaagaacg

SEQ ID NO: 6603 - DNA, 10 bp, Saccharomyces cerevisiae
ataaagatta

SEQ ID NO: 6604 - DNA, 10 bp, Saccharomyces cerevisiae
ataaagtggt

SEQ ID NO: 6605 - DNA, 10 bp, Saccharomyces cerevisiae
ataaatacca

SEQ ID NO: 6606 - DNA, 10 bp, Saccharomyces cerevisiae
ataaatcatt

SEQ ID NO: 6607 - DNA, 10 bp, Saccharomyces cerevisiae
ataaatcgct

SEQ ID NO: 6608 - DNA, 10 bp, Saccharomyces cerevisiae
ataaatctat

SEQ ID NO: 6609 - DNA, 10 bp, Saccharomyces cerevisiae
ataaatgatc

SEQ ID NO: 6610 - DNA, 10 bp, Saccharomyces cerevisiae
ataaatggaa

SEQ ID NO: 6611 - DNA, 10 bp, Saccharomyces cerevisiae
ataacaacag

SEQ ID NO: 6612 - DNA, 10 bp, Saccharomyces cerevisiae
ataacagaga

SEQ ID NO: 6613 - DNA, 10 bp, Saccharomyces cerevisiae
ataacagcaa

SEQ ID NO: 6614 - DNA, 10 bp, Saccharomyces cerevisiae
ataacagtca

SEQ ID NO: 6615 - DNA, 10 bp, Saccharomyces cerevisiae
ataaccaaaa

SEQ ID NO: 6616 - DNA, 10 bp, Saccharomyces cerevisiae
ataacgacag

SEQ ID NO: 6617 - DNA, 10 bp, Saccharomyces cerevisiae
ataacgtgaa

SEQ ID NO: 6618 - DNA, 10 bp, Saccharomyces cerevisiae
ataagcagga

SEQ ID NO: 6619 - DNA, 10 bp, Saccharomyces cerevisiae
ataagcccaa

SEQ ID NO: 6620 - DNA, 10 bp, Saccharomyces cerevisiae
ataagcgcat

SEQ ID NO: 6621 - DNA, 10 bp, Saccharomyces cerevisiae
ataagctatg

SEQ ID NO: 6622 - DNA, 10 bp, Saccharomyces cerevisiae
ataagtgatt

SEQ ID NO: 6623 - DNA, 10 bp, Saccharomyces cerevisiae
ataagtgcca

SEQ ID NO: 6624 - DNA, 10 bp, Saccharomyces cerevisiae
ataagtgttt

SEQ ID NO: 6625 - DNA, 10 bp, Saccharomyces cerevisiae
ataagttaac

SEQ ID NO: 6626 - DNA, 10 bp, Saccharomyces cerevisiae
ataagtttga

SEQ ID NO: 6627 - DNA, 10 bp, Saccharomyces cerevisiae
ataataactt

SEQ ID NO: 6628 - DNA, 10 bp, Saccharomyces cerevisiae
ataataattt

SEQ ID NO: 6629 - DNA, 10 bp, Saccharomyces cerevisiae
ataatatatt

SEQ ID NO: 6630 - DNA, 10 bp, Saccharomyces cerevisiae
ataatatcga

SEQ ID NO: 6631 - DNA, 10 bp, Saccharomyces cerevisiae
ataatcgcct

SEQ ID NO: 6632 - DNA, 10 bp, Saccharomyces cerevisiae
ataatgaaca

SEQ ID NO: 6633 - DNA, 10 bp, Saccharomyces cerevisiae
ataatgaact

SEQ ID NO: 6634 - DNA, 10 bp, Saccharomyces cerevisiae
ataatggact

SEQ ID NO: 6635 - DNA, 10 bp, Saccharomyces cerevisiae
ataatggcac

SEQ ID NO: 6636 - DNA, 10 bp, Saccharomyces cerevisiae
ataatggcgt

SEQ ID NO: 6637 - DNA, 10 bp, Saccharomyces cerevisiae
ataatgtact

SEQ ID NO: 6638 - DNA, 10 bp, Saccharomyces cerevisiae
ataatgtgga

SEQ ID NO: 6639 - DNA, 10 bp, Saccharomyces cerevisiae
ataatgttga

SEQ ID NO: 6640 - DNA, 10 bp, Saccharomyces cerevisiae
ataattcgtc

SEQ ID NO: 6641 - DNA, 10 bp, Saccharomyces cerevisiae
ataattgggg

SEQ ID NO: 6642 - DNA, 10 bp, Saccharomyces cerevisiae
atacaaaaaa

SEQ ID NO: 6643 - DNA, 10 bp, Saccharomyces cerevisiae
atacaaactg

SEQ ID NO: 6644 - DNA, 10 bp, Saccharomyces cerevisiae
atacaaggta

SEQ ID NO: 6645 - DNA, 10 bp, Saccharomyces cerevisiae
atacaaggtg

SEQ ID NO: 6646 - DNA, 10 bp, Saccharomyces cerevisiae
atacaagttt

SEQ ID NO: 6647 - DNA, 10 bp, Saccharomyces cerevisiae
atacacataa

SEQ ID NO: 6648 - DNA, 10 bp, Saccharomyces cerevisiae
atacactggt

SEQ ID NO: 6649 - DNA, 10 bp, Saccharomyces cerevisiae
atacagatta

SEQ ID NO: 6650 - DNA, 10 bp, Saccharomyces cerevisiae
atacaggatt

SEQ ID NO: 6651 - DNA, 10 bp, Saccharomyces cerevisiae
atacataaaa

SEQ ID NO: 6652 - DNA, 10 bp, Saccharomyces cerevisiae
atacatttaa

SEQ ID NO: 6653 - DNA, 10 bp, Saccharomyces cerevisiae
atacatttct

SEQ ID NO: 6654 - DNA, 10 bp, Saccharomyces cerevisiae
ataccactcc

SEQ ID NO: 6655 - DNA, 10 bp, Saccharomyces cerevisiae
atacctcttc

SEQ ID NO: 6656 - DNA, 10 bp, Saccharomyces cerevisiae
atacctttag

SEQ ID NO: 6657 - DNA, 10 bp, Saccharomyces cerevisiae
atacgattac

SEQ ID NO: 6658 - DNA, 10 bp, Saccharomyces cerevisiae
atacgccgct

SEQ ID NO: 6659 - DNA, 10 bp, Saccharomyces cerevisiae
atacgggccc

SEQ ID NO: 6660 - DNA, 10 bp, Saccharomyces cerevisiae
atacgtattt

SEQ ID NO: 6661 - DNA, 10 bp, Saccharomyces cerevisiae
atacgtttgt

SEQ ID NO: 6662 - DNA, 10 bp, Saccharomyces cerevisiae
atactaccaa

SEQ ID NO: 6663 - DNA, 10 bp, Saccharomyces cerevisiae
atactagata

SEQ ID NO: 6664 - DNA, 10 bp, Saccharomyces cerevisiae
atactccaat

SEQ ID NO: 6665 - DNA, 10 bp, Saccharomyces cerevisiae
atactgaaag

SEQ ID NO: 6666 - DNA, 10 bp, Saccharomyces cerevisiae
atactgctgc

SEQ ID NO: 6667 - DNA, 10 bp, Saccharomyces cerevisiae
atactggtgc

SEQ ID NO: 6668 - DNA, 10 bp, Saccharomyces cerevisiae
atacttcgtc

SEQ ID NO: 6669 - DNA, 10 bp, Saccharomyces cerevisiae
atacttggct

SEQ ID NO: 6670 - DNA, 10 bp, Saccharomyces cerevisiae
atactttcta

SEQ ID NO: 6671 - DNA, 10 bp, Saccharomyces cerevisiae
atagaaactg

SEQ ID NO: 6672 - DNA, 10 bp, Saccharomyces cerevisiae
atagaaagag

SEQ ID NO: 6673 - DNA, 10 bp, Saccharomyces cerevisiae
atagaaatcc

SEQ ID NO: 6674 - DNA, 10 bp, Saccharomyces cerevisiae
atagaagtta

SEQ ID NO: 6675 - DNA, 10 bp, Saccharomyces cerevisiae
atagaatgca

SEQ ID NO: 6676 - DNA, 10 bp, Saccharomyces cerevisiae
atagacagag

SEQ ID NO: 6677 - DNA, 10 bp, Saccharomyces cerevisiae
atagagacaa

SEQ ID NO: 6678 - DNA, 10 bp, Saccharomyces cerevisiae
atagagccat

SEQ ID NO: 6679 - DNA, 10 bp, Saccharomyces cerevisiae
atagagccgg

SEQ ID NO: 6680 - DNA, 10 bp, Saccharomyces cerevisiae
atagagttaa

SEQ ID NO: 6681 - DNA, 10 bp, Saccharomyces cerevisiae
atagatttaa

SEQ ID NO: 6682 - DNA, 10 bp, Saccharomyces cerevisiae
atagatttag

SEQ ID NO: 6683 - DNA, 10 bp, Saccharomyces cerevisiae
atagccgctc

SEQ ID NO: 6684 - DNA, 10 bp, Saccharomyces cerevisiae
atagcgaact

SEQ ID NO: 6685 - DNA, 10 bp, Saccharomyces cerevisiae
atagctccat

SEQ ID NO: 6686 - DNA, 10 bp, Saccharomyces cerevisiae
ataggctaca

SEQ ID NO: 6687 - DNA, 10 bp, Saccharomyces cerevisiae
ataggctcga

SEQ ID NO: 6688 - DNA, 10 bp, Saccharomyces cerevisiae
ataggtatct

SEQ ID NO: 6689 - DNA, 10 bp, Saccharomyces cerevisiae
ataggtttga

SEQ ID NO: 6690 - DNA, 10 bp, Saccharomyces cerevisiae
atagtcgtgc

SEQ ID NO: 6691 - DNA, 10 bp, Saccharomyces cerevisiae
atagttaagg

SEQ ID NO: 6692 - DNA, 10 bp, Saccharomyces cerevisiae
atagttccca

SEQ ID NO: 6693 - DNA, 10 bp, Saccharomyces cerevisiae
atagttgaaa

SEQ ID NO: 6694 - DNA, 10 bp, Saccharomyces cerevisiae
atagtttcta

SEQ ID NO: 6695 - DNA, 10 bp, Saccharomyces cerevisiae
atataagtac

SEQ ID NO: 6696 - DNA, 10 bp, Saccharomyces cerevisiae
atatacgaca

SEQ ID NO: 6697 - DNA, 10 bp, Saccharomyces cerevisiae
atatagcggc

SEQ ID NO: 6698 - DNA, 10 bp, Saccharomyces cerevisiae
atataggcct

SEQ ID NO: 6699 - DNA, 10 bp, Saccharomyces cerevisiae
atatagtggt

SEQ ID NO: 6700 - DNA, 10 bp, Saccharomyces cerevisiae
atatataagg

SEQ ID NO: 6701 - DNA, 10 bp, Saccharomyces cerevisiae
atatataggt

SEQ ID NO: 6702 - DNA, 10 bp, Saccharomyces cerevisiae
atatatgtcc

SEQ ID NO: 6703 - DNA, 10 bp, Saccharomyces cerevisiae
atatattcca

SEQ ID NO: 6704 - DNA, 10 bp, Saccharomyces cerevisiae
atatattggt

SEQ ID NO: 6705 - DNA, 10 bp, Saccharomyces cerevisiae
atatcaagaa

SEQ ID NO: 6706 - DNA, 10 bp, Saccharomyces cerevisiae
atatcaagca

SEQ ID NO: 6707 - DNA, 10 bp, Saccharomyces cerevisiae
atatcacaat

SEQ ID NO: 6708 - DNA, 10 bp, Saccharomyces cerevisiae
atatcagcag

SEQ ID NO: 6709 - DNA, 10 bp, Saccharomyces cerevisiae
atatccattg

SEQ ID NO: 6710 - DNA, 10 bp, Saccharomyces cerevisiae
atatccgtat

SEQ ID NO: 6711 - DNA, 10 bp, Saccharomyces cerevisiae
atatcgaaaa

SEQ ID NO: 6712 - DNA, 10 bp, Saccharomyces cerevisiae
atatcgatgg

SEQ ID NO: 6713 - DNA, 10 bp, Saccharomyces cerevisiae
atatcgtcag

SEQ ID NO: 6714 - DNA, 10 bp, Saccharomyces cerevisiae
atatctagtt

SEQ ID NO: 6715 - DNA, 10 bp, Saccharomyces cerevisiae
atatctcata

SEQ ID NO: 6716 - DNA, 10 bp, Saccharomyces cerevisiae
atatctctgt

SEQ ID NO: 6717 - DNA, 10 bp, Saccharomyces cerevisiae
atatctgttt

SEQ ID NO: 6718 - DNA, 10 bp, Saccharomyces cerevisiae
atatctttaa

SEQ ID NO: 6719 - DNA, 10 bp, Saccharomyces cerevisiae
atatctttga

SEQ ID NO: 6720 - DNA, 10 bp, Saccharomyces cerevisiae
atatgaagaa

SEQ ID NO: 6721 - DNA, 10 bp, Saccharomyces cerevisiae
atatggagaa

SEQ ID NO: 6722 - DNA, 10 bp, Saccharomyces cerevisiae
atatggataa

SEQ ID NO: 6723 - DNA, 10 bp, Saccharomyces cerevisiae
atatggattt

SEQ ID NO: 6724 - DNA, 10 bp, Saccharomyces cerevisiae
atatgggtgg

SEQ ID NO: 6725 - DNA, 10 bp, Saccharomyces cerevisiae
atattaaaat

SEQ ID NO: 6726 - DNA, 10 bp, Saccharomyces cerevisiae
atattaacat

SEQ ID NO: 6727 - DNA, 10 bp, Saccharomyces cerevisiae
atattagcac

SEQ ID NO: 6728 - DNA, 10 bp, Saccharomyces cerevisiae
atattataaa

SEQ ID NO: 6729 - DNA, 10 bp, Saccharomyces cerevisiae
atattattag

SEQ ID NO: 6730 - DNA, 10 bp, Saccharomyces cerevisiae
atattcaaga

SEQ ID NO: 6731 - DNA, 10 bp, Saccharomyces cerevisiae
atattcagaa

SEQ ID NO: 6732 - DNA, 10 bp, Saccharomyces cerevisiae
atattcgatg

SEQ ID NO: 6733 - DNA, 10 bp, Saccharomyces cerevisiae
atattgactt

SEQ ID NO: 6734 - DNA, 10 bp, Saccharomyces cerevisiae
atattgatat

SEQ ID NO: 6735 - DNA, 10 bp, Saccharomyces cerevisiae
atattggaac

SEQ ID NO: 6736 - DNA, 10 bp, Saccharomyces cerevisiae
atatttatcg

SEQ ID NO: 6737 - DNA, 10 bp, Saccharomyces cerevisiae
atatttgcta

SEQ ID NO: 6738 - DNA, 10 bp, Saccharomyces cerevisiae
atattttctg

SEQ ID NO: 6739 - DNA, 10 bp, Saccharomyces cerevisiae
atcaaaaact

SEQ ID NO: 6740 - DNA, 10 bp, Saccharomyces cerevisiae
atcaaaaagt

SEQ ID NO: 6741 - DNA, 10 bp, Saccharomyces cerevisiae
atcaaaattt

SEQ ID NO: 6742 - DNA, 10 bp, Saccharomyces cerevisiae
atcaaacgct

SEQ ID NO: 6743 - DNA, 10 bp, Saccharomyces cerevisiae
atcaaagtgc

SEQ ID NO: 6744 - DNA, 10 bp, Saccharomyces cerevisiae
atcaaatata

SEQ ID NO: 6745 - DNA, 10 bp, Saccharomyces cerevisiae
atcaaatcca

SEQ ID NO: 6746 - DNA, 10 bp, Saccharomyces cerevisiae
atcaaatcta

SEQ ID NO: 6747 - DNA, 10 bp, Saccharomyces cerevisiae
atcaacgcta

SEQ ID NO: 6748 - DNA, 10 bp, Saccharomyces cerevisiae
atcaaggtgc

SEQ ID NO: 6749 - DNA, 10 bp, Saccharomyces cerevisiae
atcaagttac

SEQ ID NO: 6750 - DNA, 10 bp, Saccharomyces cerevisiae
atcaatatgc

SEQ ID NO: 6751 - DNA, 10 bp, Saccharomyces cerevisiae
atcaccaaaa

SEQ ID NO: 6752 - DNA, 10 bp, Saccharomyces cerevisiae
atcacccacg

SEQ ID NO: 6753 - DNA, 10 bp, Saccharomyces cerevisiae
atcacctgcc

SEQ ID NO: 6754 - DNA, 10 bp, Saccharomyces cerevisiae
atcacgccct

SEQ ID NO: 6755 - DNA, 10 bp, Saccharomyces cerevisiae
atcacgctcc

SEQ ID NO: 6756 - DNA, 10 bp, Saccharomyces cerevisiae
atcacgggtg

SEQ ID NO: 6757 - DNA, 10 bp, Saccharomyces cerevisiae
atcactcctg

SEQ ID NO: 6758 - DNA, 10 bp, Saccharomyces cerevisiae
atcactggcg

SEQ ID NO: 6759 - DNA, 10 bp, Saccharomyces cerevisiae
atcactggga

SEQ ID NO: 6760 - DNA, 10 bp, Saccharomyces cerevisiae
atcagaaata

SEQ ID NO: 6761 - DNA, 10 bp, Saccharomyces cerevisiae
atcaggttgg

SEQ ID NO: 6762 - DNA, 10 bp, Saccharomyces cerevisiae
atcagtagtt

SEQ ID NO: 6763 - DNA, 10 bp, Saccharomyces cerevisiae
atcagtgtta

SEQ ID NO: 6764 - DNA, 10 bp, Saccharomyces cerevisiae
atcagtttct

SEQ ID NO: 6765 - DNA, 10 bp, Saccharomyces cerevisiae
atcataagat

SEQ ID NO: 6766 - DNA, 10 bp, Saccharomyces cerevisiae
atcatcaaag

SEQ ID NO: 6767 - DNA, 10 bp, Saccharomyces cerevisiae
atcatttaga

SEQ ID NO: 6768 - DNA, 10 bp, Saccharomyces cerevisiae
atcattttcc

SEQ ID NO: 6769 - DNA, 10 bp, Saccharomyces cerevisiae
atccaaggtg

SEQ ID NO: 6770 - DNA, 10 bp, Saccharomyces cerevisiae
atccaattat

SEQ ID NO: 6771 - DNA, 10 bp, Saccharomyces cerevisiae
atccactggt

SEQ ID NO: 6772 - DNA, 10 bp, Saccharomyces cerevisiae
atccaggtgc

SEQ ID NO: 6773 - DNA, 10 bp, Saccharomyces cerevisiae
atccatatta

SEQ ID NO: 6774 - DNA, 10 bp, Saccharomyces cerevisiae
atccatcatt

SEQ ID NO: 6775 - DNA, 10 bp, Saccharomyces cerevisiae
atccatttct

SEQ ID NO: 6776 - DNA, 10 bp, Saccharomyces cerevisiae
atcccagctc

SEQ ID NO: 6777 - DNA, 10 bp, Saccharomyces cerevisiae
atcccagctt

SEQ ID NO: 6778 - DNA, 10 bp, Saccharomyces cerevisiae
atccccatag

SEQ ID NO: 6779 - DNA, 10 bp, Saccharomyces cerevisiae
atcccgtttg

SEQ ID NO: 6780 - DNA, 10 bp, Saccharomyces cerevisiae
atccctccaa

SEQ ID NO: 6781 - DNA, 10 bp, Saccharomyces cerevisiae
atccctgtta

SEQ ID NO: 6782 - DNA, 10 bp, Saccharomyces cerevisiae
atcccttacc

SEQ ID NO: 6783 - DNA, 10 bp, Saccharomyces cerevisiae
atcccttctt

SEQ ID NO: 6784 - DNA, 10 bp, Saccharomyces cerevisiae
atcccttgaa

SEQ ID NO: 6785 - DNA, 10 bp, Saccharomyces cerevisiae
atccgaacaa

SEQ ID NO: 6786 - DNA, 10 bp, Saccharomyces cerevisiae
atccgccatc

SEQ ID NO: 6787 - DNA, 10 bp, Saccharomyces cerevisiae
atccgcgcac

SEQ ID NO: 6788 - DNA, 10 bp, Saccharomyces cerevisiae
atccgcggat

SEQ ID NO: 6789 - DNA, 10 bp, Saccharomyces cerevisiae
atccggaggc

SEQ ID NO: 6790 - DNA, 10 bp, Saccharomyces cerevisiae
atccggaggt

SEQ ID NO: 6791 - DNA, 10 bp, Saccharomyces cerevisiae
atccgttcta

SEQ ID NO: 6792 - DNA, 10 bp, Saccharomyces cerevisiae
atcctattat

SEQ ID NO: 6793 - DNA, 10 bp, Saccharomyces cerevisiae
atcctcgtca

SEQ ID NO: 6794 - DNA, 10 bp, Saccharomyces cerevisiae
atcctgaatc

SEQ ID NO: 6795 - DNA, 10 bp, Saccharomyces cerevisiae
atccttgtgc

SEQ ID NO: 6796 - DNA, 10 bp, Saccharomyces cerevisiae
atcgagaatg

SEQ ID NO: 6797 - DNA, 10 bp, Saccharomyces cerevisiae
atcgaggata

SEQ ID NO: 6798 - DNA, 10 bp, Saccharomyces cerevisiae
atcgatatct

SEQ ID NO: 6799 - DNA, 10 bp, Saccharomyces cerevisiae
atcgattaaa

SEQ ID NO: 6800 - DNA, 10 bp, Saccharomyces cerevisiae
atcgattgaa

SEQ ID NO: 6801 - DNA, 10 bp, Saccharomyces cerevisiae
atcgcacaat

SEQ ID NO: 6802 - DNA, 10 bp, Saccharomyces cerevisiae
atcgcaccaa

SEQ ID NO: 6803 - DNA, 10 bp, Saccharomyces cerevisiae
atcgccactc

SEQ ID NO: 6804 - DNA, 10 bp, Saccharomyces cerevisiae
atcgccgcca

SEQ ID NO: 6805 - DNA, 10 bp, Saccharomyces cerevisiae
atcgccgccc

SEQ ID NO: 6806 - DNA, 10 bp, Saccharomyces cerevisiae
atcgccgcta

SEQ ID NO: 6807 - DNA, 10 bp, Saccharomyces cerevisiae
atcgccgctg

SEQ ID NO: 6808 - DNA, 10 bp, Saccharomyces cerevisiae
atcgccggct

SEQ ID NO: 6809 - DNA, 10 bp, Saccharomyces cerevisiae
atcgccggtc

SEQ ID NO: 6810 - DNA, 10 bp, Saccharomyces cerevisiae
atcgccgtca

SEQ ID NO: 6811 - DNA, 10 bp, Saccharomyces cerevisiae
atcgcctttg

SEQ ID NO: 6812 - DNA, 10 bp, Saccharomyces cerevisiae
atcgcttaaa

SEQ ID NO: 6813 - DNA, 10 bp, Saccharomyces cerevisiae
atcggcgctc

SEQ ID NO: 6814 - DNA, 10 bp, Saccharomyces cerevisiae
atcggcggct

SEQ ID NO: 6815 - DNA, 10 bp, Saccharomyces cerevisiae
atcggtcctc

SEQ ID NO: 6816 - DNA, 10 bp, Saccharomyces cerevisiae
atcggtgctt

SEQ ID NO: 6817 - DNA, 10 bp, Saccharomyces cerevisiae
atcgtacaat

SEQ ID NO: 6818 - DNA, 10 bp, Saccharomyces cerevisiae
atcgtattta

SEQ ID NO: 6819 - DNA, 10 bp, Saccharomyces cerevisiae
atcgtctagg

SEQ ID NO: 6820 - DNA, 10 bp, Saccharomyces cerevisiae
atcgtgcggg

SEQ ID NO: 6821 - DNA, 10 bp, Saccharomyces cerevisiae
atcgtggaac

SEQ ID NO: 6822 - DNA, 10 bp, Saccharomyces cerevisiae
atcgtggtgg

SEQ ID NO: 6823 - DNA, 10 bp, Saccharomyces cerevisiae
atcgttacgg

SEQ ID NO: 6824 - DNA, 10 bp, Saccharomyces cerevisiae
atcgttttac

SEQ ID NO: 6825 - DNA, 10 bp, Saccharomyces cerevisiae
atctaattcc

SEQ ID NO: 6826 - DNA, 10 bp, Saccharomyces cerevisiae
atctacaggt

SEQ ID NO: 6827 - DNA, 10 bp, Saccharomyces cerevisiae
atctagtctg

SEQ ID NO: 6828 - DNA, 10 bp, Saccharomyces cerevisiae
atctatgtaa

SEQ ID NO: 6829 - DNA, 10 bp, Saccharomyces cerevisiae
atctcaacat

SEQ ID NO: 6830 - DNA, 10 bp, Saccharomyces cerevisiae
atctcacaaa

SEQ ID NO: 6831 - DNA, 10 bp, Saccharomyces cerevisiae
atctcagtgc

SEQ ID NO: 6832 - DNA, 10 bp, Saccharomyces cerevisiae
atctccagaa

SEQ ID NO: 6833 - DNA, 10 bp, Saccharomyces cerevisiae
atctcccaat

SEQ ID NO: 6834 - DNA, 10 bp, Saccharomyces cerevisiae
atctcctaat

SEQ ID NO: 6835 - DNA, 10 bp, Saccharomyces cerevisiae
atctcctcta

SEQ ID NO: 6836 - DNA, 10 bp, Saccharomyces cerevisiae
atctcctttc

SEQ ID NO: 6837 - DNA, 10 bp, Saccharomyces cerevisiae
atctcgaagc

SEQ ID NO: 6838 - DNA, 10 bp, Saccharomyces cerevisiae
atctgacgat

SEQ ID NO: 6839 - DNA, 10 bp, Saccharomyces cerevisiae
atctgctaca

SEQ ID NO: 6840 - DNA, 10 bp, Saccharomyces cerevisiae
atctgctcat

SEQ ID NO: 6841 - DNA, 10 bp, Saccharomyces cerevisiae
atctggatat

SEQ ID NO: 6842 - DNA, 10 bp, Saccharomyces cerevisiae
atctggattt

SEQ ID NO: 6843 - DNA, 10 bp, Saccharomyces cerevisiae
atctgtaaaa

SEQ ID NO: 6844 - DNA, 10 bp, Saccharomyces cerevisiae
atctgtattc

SEQ ID NO: 6845 - DNA, 10 bp, Saccharomyces cerevisiae
atctgtcatc

SEQ ID NO: 6846 - DNA, 10 bp, Saccharomyces cerevisiae
atctgtgata

SEQ ID NO: 6847 - DNA, 10 bp, Saccharomyces cerevisiae
atctgtggct

SEQ ID NO: 6848 - DNA, 10 bp, Saccharomyces cerevisiae
atctgttcgc

SEQ ID NO: 6849 - DNA, 10 bp, Saccharomyces cerevisiae
atcttaattc

SEQ ID NO: 6850 - DNA, 10 bp, Saccharomyces cerevisiae
atcttagttt

SEQ ID NO: 6851 - DNA, 10 bp, Saccharomyces cerevisiae
atcttcacta

SEQ ID NO: 6852 - DNA, 10 bp, Saccharomyces cerevisiae
atcttcttgt

SEQ ID NO: 6853 - DNA, 10 bp, Saccharomyces cerevisiae
atcttgaagc

SEQ ID NO: 6854 - DNA, 10 bp, Saccharomyces cerevisiae
atctttaact

SEQ ID NO: 6855 - DNA, 10 bp, Saccharomyces cerevisiae
atctttaata

SEQ ID NO: 6856 - DNA, 10 bp, Saccharomyces cerevisiae
atctttattt

SEQ ID NO: 6857 - DNA, 10 bp, Saccharomyces cerevisiae
atctttctca

SEQ ID NO: 6858 - DNA, 10 bp, Saccharomyces cerevisiae
atctttgcct

SEQ ID NO: 6859 - DNA, 10 bp, Saccharomyces cerevisiae
atctttgtca

SEQ ID NO: 6860 - DNA, 10 bp, Saccharomyces cerevisiae
atcttttcgt

SEQ ID NO: 6861 - DNA, 10 bp, Saccharomyces cerevisiae
atctttttat

SEQ ID NO: 6862 - DNA, 10 bp, Saccharomyces cerevisiae
atcttttttg

SEQ ID NO: 6863 - DNA, 10 bp, Saccharomyces cerevisiae
atgaaagttc

SEQ ID NO: 6864 - DNA, 10 bp, Saccharomyces cerevisiae
atgaaggaaa

SEQ ID NO: 6865 - DNA, 10 bp, Saccharomyces cerevisiae
atgaaggatc

SEQ ID NO: 6866 - DNA, 10 bp, Saccharomyces cerevisiae
atgaagggtt

SEQ ID NO: 6867 - DNA, 10 bp, Saccharomyces cerevisiae
atgaagtaaa

SEQ ID NO: 6868 - DNA, 10 bp, Saccharomyces cerevisiae
atgaagttaa

SEQ ID NO: 6869 - DNA, 10 bp, Saccharomyces cerevisiae
atgaattatc

SEQ ID NO: 6870 - DNA, 10 bp, Saccharomyces cerevisiae
atgaattgaa

SEQ ID NO: 6871 - DNA, 10 bp, Saccharomyces cerevisiae
atgacaacgc

SEQ ID NO: 6872 - DNA, 10 bp, Saccharomyces cerevisiae
atgacattta

SEQ ID NO: 6873 - DNA, 10 bp, Saccharomyces cerevisiae
atgaccaggc

SEQ ID NO: 6874 - DNA, 10 bp, Saccharomyces cerevisiae
atgactaagt

SEQ ID NO: 6875 - DNA, 10 bp, Saccharomyces cerevisiae
atgactggtg

SEQ ID NO: 6876 - DNA, 10 bp, Saccharomyces cerevisiae
atgagacaaa

SEQ ID NO: 6877 - DNA, 10 bp, Saccharomyces cerevisiae
atgagagcgc

SEQ ID NO: 6878 - DNA, 10 bp, Saccharomyces cerevisiae
atgagatgcg

SEQ ID NO: 6879 - DNA, 10 bp, Saccharomyces cerevisiae
atgagattac

SEQ ID NO: 6880 - DNA, 10 bp, Saccharomyces cerevisiae
atgagcagaa

SEQ ID NO: 6881 - DNA, 10 bp, Saccharomyces cerevisiae
atgagctatg

SEQ ID NO: 6882 - DNA, 10 bp, Saccharomyces cerevisiae
atgagctgcg

SEQ ID NO: 6883 - DNA, 10 bp, Saccharomyces cerevisiae
atgaggaacg

SEQ ID NO: 6884 - DNA, 10 bp, Saccharomyces cerevisiae
atgaggaact

SEQ ID NO: 6885 - DNA, 10 bp, Saccharomyces cerevisiae
atgaggagag

SEQ ID NO: 6886 - DNA, 10 bp, Saccharomyces cerevisiae
atgagggttc

SEQ ID NO: 6887 - DNA, 10 bp, Saccharomyces cerevisiae
atgaggtcca

SEQ ID NO: 6888 - DNA, 10 bp, Saccharomyces cerevisiae
atgaggttcc

SEQ ID NO: 6889 - DNA, 10 bp, Saccharomyces cerevisiae
atgagtagta

SEQ ID NO: 6890 - DNA, 10 bp, Saccharomyces cerevisiae
atgagttact

SEQ ID NO: 6891 - DNA, 10 bp, Saccharomyces cerevisiae
atgataacgc

SEQ ID NO: 6892 - DNA, 10 bp, Saccharomyces cerevisiae
atgataatgc

SEQ ID NO: 6893 - DNA, 10 bp, Saccharomyces cerevisiae
atgatacaag

SEQ ID NO: 6894 - DNA, 10 bp, Saccharomyces cerevisiae
atgatacgcg

SEQ ID NO: 6895 - DNA, 10 bp, Saccharomyces cerevisiae
atgatagcaa

SEQ ID NO: 6896 - DNA, 10 bp, Saccharomyces cerevisiae
atgatagcag

SEQ ID NO: 6897 - DNA, 10 bp, Saccharomyces cerevisiae
atgatagtac

SEQ ID NO: 6898 - DNA, 10 bp, Saccharomyces cerevisiae
atgatcagtc

SEQ ID NO: 6899 - DNA, 10 bp, Saccharomyces cerevisiae
atgatccaca

SEQ ID NO: 6900 - DNA, 10 bp, Saccharomyces cerevisiae
atgatccctg

SEQ ID NO: 6901 - DNA, 10 bp, Saccharomyces cerevisiae
atgatcctga

SEQ ID NO: 6902 - DNA, 10 bp, Saccharomyces cerevisiae
atgatcggtt

SEQ ID NO: 6903 - DNA, 10 bp, Saccharomyces cerevisiae
atgatgaact

SEQ ID NO: 6904 - DNA, 10 bp, Saccharomyces cerevisiae
atgatgataa

SEQ ID NO: 6905 - DNA, 10 bp, Saccharomyces cerevisiae
atgatgcaaa

SEQ ID NO: 6906 - DNA, 10 bp, Saccharomyces cerevisiae
atgatgccgg

SEQ ID NO: 6907 - DNA, 10 bp, Saccharomyces cerevisiae
atgatgttcc

SEQ ID NO: 6908 - DNA, 10 bp, Saccharomyces cerevisiae
atgatgttga

SEQ ID NO: 6909 - DNA, 10 bp, Saccharomyces cerevisiae
atgattaaca

SEQ ID NO: 6910 - DNA, 10 bp, Saccharomyces cerevisiae
atgattacct

SEQ ID NO: 6911 - DNA, 10 bp, Saccharomyces cerevisiae
atgattactg

SEQ ID NO: 6912 - DNA, 10 bp, Saccharomyces cerevisiae
atgattgttt

SEQ ID NO: 6913 - DNA, 10 bp, Saccharomyces cerevisiae
atgattttga

SEQ ID NO: 6914 - DNA, 10 bp, Saccharomyces cerevisiae
atgcaacagt

SEQ ID NO: 6915 - DNA, 10 bp, Saccharomyces cerevisiae
atgcaacgcc

SEQ ID NO: 6916 - DNA, 10 bp, Saccharomyces cerevisiae
atgcaagtgt

SEQ ID NO: 6917 - DNA, 10 bp, Saccharomyces cerevisiae
atgcaatatt

SEQ ID NO: 6918 - DNA, 10 bp, Saccharomyces cerevisiae
atgcacctac

SEQ ID NO: 6919 - DNA, 10 bp, Saccharomyces cerevisiae
atgcatcccc

SEQ ID NO: 6920 - DNA, 10 bp, Saccharomyces cerevisiae
atgccaacca

SEQ ID NO: 6921 - DNA, 10 bp, Saccharomyces cerevisiae
atgccactac

SEQ ID NO: 6922 - DNA, 10 bp, Saccharomyces cerevisiae
atgccagtct

SEQ ID NO: 6923 - DNA, 10 bp, Saccharomyces cerevisiae
atgccattcg

SEQ ID NO: 6924 - DNA, 10 bp, Saccharomyces cerevisiae
atgcctgcca

SEQ ID NO: 6925 - DNA, 10 bp, Saccharomyces cerevisiae
atgccttacc

SEQ ID NO: 6926 - DNA, 10 bp, Saccharomyces cerevisiae
atgcctttct

SEQ ID NO: 6927 - DNA, 10 bp, Saccharomyces cerevisiae
atgcgaacat

SEQ ID NO: 6928 - DNA, 10 bp, Saccharomyces cerevisiae
atgcgatttc

SEQ ID NO: 6929 - DNA, 10 bp, Saccharomyces cerevisiae
atgcgttatt

SEQ ID NO: 6930 - DNA, 10 bp, Saccharomyces cerevisiae
atgctagctg

SEQ ID NO: 6931 - DNA, 10 bp, Saccharomyces cerevisiae
atgctaggcg

SEQ ID NO: 6932 - DNA, 10 bp, Saccharomyces cerevisiae
atgctcagcc

SEQ ID NO: 6933 - DNA, 10 bp, Saccharomyces cerevisiae
atgctccacg

SEQ ID NO: 6934 - DNA, 10 bp, Saccharomyces cerevisiae
atgctggggg

SEQ ID NO: 6935 - DNA, 10 bp, Saccharomyces cerevisiae
atgctgtcga

SEQ ID NO: 6936 - DNA, 10 bp, Saccharomyces cerevisiae
atgcttaggg

SEQ ID NO: 6937 - DNA, 10 bp, Saccharomyces cerevisiae
atgcttttct

SEQ ID NO: 6938 - DNA, 10 bp, Saccharomyces cerevisiae
atggaaaact

SEQ ID NO: 6939 - DNA, 10 bp, Saccharomyces cerevisiae
atggaagaac

SEQ ID NO: 6940 - DNA, 10 bp, Saccharomyces cerevisiae
atggacctcc

SEQ ID NO: 6941 - DNA, 10 bp, Saccharomyces cerevisiae
atggactcca

SEQ ID NO: 6942 - DNA, 10 bp, Saccharomyces cerevisiae
atggactgaa

SEQ ID NO: 6943 - DNA, 10 bp, Saccharomyces cerevisiae
atggagtcgt

SEQ ID NO: 6944 - DNA, 10 bp, Saccharomyces cerevisiae
atggataaat

SEQ ID NO: 6945 - DNA, 10 bp, Saccharomyces cerevisiae
atggattacg

SEQ ID NO: 6946 - DNA, 10 bp, Saccharomyces cerevisiae
atggatttaa

SEQ ID NO: 6947 - DNA, 10 bp, Saccharomyces cerevisiae
atggcaccgc

SEQ ID NO: 6948 - DNA, 10 bp, Saccharomyces cerevisiae
atggcattgc

SEQ ID NO: 6949 - DNA, 10 bp, Saccharomyces cerevisiae
atggccatct

SEQ ID NO: 6950 - DNA, 10 bp, Saccharomyces cerevisiae
atggcccaca

SEQ ID NO: 6951 - DNA, 10 bp, Saccharomyces cerevisiae
atggcgaatc

SEQ ID NO: 6952 - DNA, 10 bp, Saccharomyces cerevisiae
atggcgagta

SEQ ID NO: 6953 - DNA, 10 bp, Saccharomyces cerevisiae
atggctaaat

SEQ ID NO: 6954 - DNA, 10 bp, Saccharomyces cerevisiae
atggctcaaa

SEQ ID NO: 6955 - DNA, 10 bp, Saccharomyces cerevisiae
atggctcaga

SEQ ID NO: 6956 - DNA, 10 bp, Saccharomyces cerevisiae
atgggatttt

SEQ ID NO: 6957 - DNA, 10 bp, Saccharomyces cerevisiae
atgggcaccg

SEQ ID NO: 6958 - DNA, 10 bp, Saccharomyces cerevisiae
atgggctccc

SEQ ID NO: 6959 - DNA, 10 bp, Saccharomyces cerevisiae
atgggcttct

SEQ ID NO: 6960 - DNA, 10 bp, Saccharomyces cerevisiae
atgggtggtt

SEQ ID NO: 6961 - DNA, 10 bp, Saccharomyces cerevisiae
atggtaatgg

SEQ ID NO: 6962 - DNA, 10 bp, Saccharomyces cerevisiae
atggtatgac

SEQ ID NO: 6963 - DNA, 10 bp, Saccharomyces cerevisiae
atggtgagca

SEQ ID NO: 6964 - DNA, 10 bp, Saccharomyces cerevisiae
atggtgatga

SEQ ID NO: 6965 - DNA, 10 bp, Saccharomyces cerevisiae
atggtgcatc

SEQ ID NO: 6966 - DNA, 10 bp, Saccharomyces cerevisiae
atggtgtctc

SEQ ID NO: 6967 - DNA, 10 bp, Saccharomyces cerevisiae
atggtgtgat

SEQ ID NO: 6968 - DNA, 10 bp, Saccharomyces cerevisiae
atggtgttaa

SEQ ID NO: 6969 - DNA, 10 bp, Saccharomyces cerevisiae
atggttatac

SEQ ID NO: 6970 - DNA, 10 bp, Saccharomyces cerevisiae
atggttttct

SEQ ID NO: 6971 - DNA, 10 bp, Saccharomyces cerevisiae
atgtaagatc

SEQ ID NO: 6972 - DNA, 10 bp, Saccharomyces cerevisiae
atgtaagatt

SEQ ID NO: 6973 - DNA, 10 bp, Saccharomyces cerevisiae
atgtaatagg

SEQ ID NO: 6974 - DNA, 10 bp, Saccharomyces cerevisiae
atgtactctt

SEQ ID NO: 6975 - DNA, 10 bp, Saccharomyces cerevisiae
atgtacttta

SEQ ID NO: 6976 - DNA, 10 bp, Saccharomyces cerevisiae
atgtaggcgg

SEQ ID NO: 6977 - DNA, 10 bp, Saccharomyces cerevisiae
atgtagtagt

SEQ ID NO: 6978 - DNA, 10 bp, Saccharomyces cerevisiae
atgtatgaga

SEQ ID NO: 6979 - DNA, 10 bp, Saccharomyces cerevisiae
atgtatggtt

SEQ ID NO: 6980 - DNA, 10 bp, Saccharomyces cerevisiae
atgtcagcat

SEQ ID NO: 6981 - DNA, 10 bp, Saccharomyces cerevisiae
atgtcatatc

SEQ ID NO: 6982 - DNA, 10 bp, Saccharomyces cerevisiae
atgtcggctt

SEQ ID NO: 6983 - DNA, 10 bp, Saccharomyces cerevisiae
atgtgatgga

SEQ ID NO: 6984 - DNA, 10 bp, Saccharomyces cerevisiae
atgtggatgt

SEQ ID NO: 6985 - DNA, 10 bp, Saccharomyces cerevisiae
atgtgtgtaa

SEQ ID NO: 6986 - DNA, 10 bp, Saccharomyces cerevisiae
atgtgttcaa

SEQ ID NO: 6987 - DNA, 10 bp, Saccharomyces cerevisiae
atgttaactt

SEQ ID NO: 6988 - DNA, 10 bp, Saccharomyces cerevisiae
atgttaagca

SEQ ID NO: 6989 - DNA, 10 bp, Saccharomyces cerevisiae
atgttatagt

SEQ ID NO: 6990 - DNA, 10 bp, Saccharomyces cerevisiae
atgttgatct

SEQ ID NO: 6991 - DNA, 10 bp, Saccharomyces cerevisiae
atgttggcga

SEQ ID NO: 6992 - DNA, 10 bp, Saccharomyces cerevisiae
atgttttatt

SEQ ID NO: 6993 - DNA, 10 bp, Saccharomyces cerevisiae
atgtttttgg

SEQ ID NO: 6994 - DNA, 10 bp, Saccharomyces cerevisiae
attaaaagat

SEQ ID NO: 6995 - DNA, 10 bp, Saccharomyces cerevisiae
attaaacgat

SEQ ID NO: 6996 - DNA, 10 bp, Saccharomyces cerevisiae
attaaagtcc

SEQ ID NO: 6997 - DNA, 10 bp, Saccharomyces cerevisiae
attaaatcct

SEQ ID NO: 6998 - DNA, 10 bp, Saccharomyces cerevisiae
attaacaaaa

SEQ ID NO: 6999 - DNA, 10 bp, Saccharomyces cerevisiae
attaacaaag

SEQ ID NO: 7000 - DNA, 10 bp, Saccharomyces cerevisiae
attaagggta

SEQ ID NO: 7001 - DNA, 10 bp, Saccharomyces cerevisiae
attaatcaat

SEQ ID NO: 7002 - DNA, 10 bp, Saccharomyces cerevisiae
attaatgaag

SEQ ID NO: 7003 - DNA, 10 bp, Saccharomyces cerevisiae
attaattaca

SEQ ID NO: 7004 - DNA, 10 bp, Saccharomyces cerevisiae
attaattttg

SEQ ID NO: 7005 - DNA, 10 bp, Saccharomyces cerevisiae
attaccaata

SEQ ID NO: 7006 - DNA, 10 bp, Saccharomyces cerevisiae
attaccgctc

SEQ ID NO: 7007 - DNA, 10 bp, Saccharomyces cerevisiae
attaccgtct

SEQ ID NO: 7008 - DNA, 10 bp, Saccharomyces cerevisiae
attacctgtt

SEQ ID NO: 7009 - DNA, 10 bp, Saccharomyces cerevisiae
attacgatac

SEQ ID NO: 7010 - DNA, 10 bp, Saccharomyces cerevisiae
attacgtgcg

SEQ ID NO: 7011 - DNA, 10 bp, Saccharomyces cerevisiae
attacgtgtg

SEQ ID NO: 7012 - DNA, 10 bp, Saccharomyces cerevisiae
attagaagaa

SEQ ID NO: 7013 - DNA, 10 bp, Saccharomyces cerevisiae
attagaatca

SEQ ID NO: 7014 - DNA, 10 bp, Saccharomyces cerevisiae
attagaatcg

SEQ ID NO: 7015 - DNA, 10 bp, Saccharomyces cerevisiae
attagatctt

SEQ ID NO: 7016 - DNA, 10 bp, Saccharomyces cerevisiae
attagtggaa

SEQ ID NO: 7017 - DNA, 10 bp, Saccharomyces cerevisiae
attagttaca

SEQ ID NO: 7018 - DNA, 10 bp, Saccharomyces cerevisiae
attatatatt

SEQ ID NO: 7019 - DNA, 10 bp, Saccharomyces cerevisiae
attatatttt

SEQ ID NO: 7020 - DNA, 10 bp, Saccharomyces cerevisiae
attatcaccg

SEQ ID NO: 7021 - DNA, 10 bp, Saccharomyces cerevisiae
attatcgaaa

SEQ ID NO: 7022 - DNA, 10 bp, Saccharomyces cerevisiae
attatctctg

SEQ ID NO: 7023 - DNA, 10 bp, Saccharomyces cerevisiae
attatctgtt

SEQ ID NO: 7024 - DNA, 10 bp, Saccharomyces cerevisiae
attattaagt

SEQ ID NO: 7025 - DNA, 10 bp, Saccharomyces cerevisiae
attattacca

SEQ ID NO: 7026 - DNA, 10 bp, Saccharomyces cerevisiae
attattcatt

SEQ ID NO: 7027 - DNA, 10 bp, Saccharomyces cerevisiae
attatttcga

SEQ ID NO: 7028 - DNA, 10 bp, Saccharomyces cerevisiae
attcaaaagt

SEQ ID NO: 7029 - DNA, 10 bp, Saccharomyces cerevisiae
attcaaacgc

SEQ ID NO: 7030 - DNA, 10 bp, Saccharomyces cerevisiae
attcaaatat

SEQ ID NO: 7031 - DNA, 10 bp, Saccharomyces cerevisiae
attcaacgtt

SEQ ID NO: 7032 - DNA, 10 bp, Saccharomyces cerevisiae
attcaactga

SEQ ID NO: 7033 - DNA, 10 bp, Saccharomyces cerevisiae
attcaactgg

SEQ ID NO: 7034 - DNA, 10 bp, Saccharomyces cerevisiae
attcaagcag

SEQ ID NO: 7035 - DNA, 10 bp, Saccharomyces cerevisiae
attcaatttc

SEQ ID NO: 7036 - DNA, 10 bp, Saccharomyces cerevisiae
attcagaagc

SEQ ID NO: 7037 - DNA, 10 bp, Saccharomyces cerevisiae
attcagattt

SEQ ID NO: 7038 - DNA, 10 bp, Saccharomyces cerevisiae
attcatatct

SEQ ID NO: 7039 - DNA, 10 bp, Saccharomyces cerevisiae
attccaaaca

SEQ ID NO: 7040 - DNA, 10 bp, Saccharomyces cerevisiae
attccaagaa

SEQ ID NO: 7041 - DNA, 10 bp, Saccharomyces cerevisiae
attccagaat

SEQ ID NO: 7042 - DNA, 10 bp, Saccharomyces cerevisiae
attcccaagt

SEQ ID NO: 7043 - DNA, 10 bp, Saccharomyces cerevisiae
attcgctagc

SEQ ID NO: 7044 - DNA, 10 bp, Saccharomyces cerevisiae
attcggcttc

SEQ ID NO: 7045 - DNA, 10 bp, Saccharomyces cerevisiae
attcgtatct

SEQ ID NO: 7046 - DNA, 10 bp, Saccharomyces cerevisiae
attcgtgtat

SEQ ID NO: 7047 - DNA, 10 bp, Saccharomyces cerevisiae
attctaactc

SEQ ID NO: 7048 - DNA, 10 bp, Saccharomyces cerevisiae
attctacgaa

SEQ ID NO: 7049 - DNA, 10 bp, Saccharomyces cerevisiae
attctagctc

SEQ ID NO: 7050 - DNA, 10 bp, Saccharomyces cerevisiae
attctctcac

SEQ ID NO: 7051 - DNA, 10 bp, Saccharomyces cerevisiae
attctctttt

SEQ ID NO: 7052 - DNA, 10 bp, Saccharomyces cerevisiae
attctgaaga

SEQ ID NO: 7053 - DNA, 10 bp, Saccharomyces cerevisiae
attctgcaat

SEQ ID NO: 7054 - DNA, 10 bp, Saccharomyces cerevisiae
attctggaaa

SEQ ID NO: 7055 - DNA, 10 bp, Saccharomyces cerevisiae
attctggacc

SEQ ID NO: 7056 - DNA, 10 bp, Saccharomyces cerevisiae
attctgggtt

SEQ ID NO: 7057 - DNA, 10 bp, Saccharomyces cerevisiae
attctggtga

SEQ ID NO: 7058 - DNA, 10 bp, Saccharomyces cerevisiae
attctggtgt

SEQ ID NO: 7059 - DNA, 10 bp, Saccharomyces cerevisiae
attcttcagg

SEQ ID NO: 7060 - DNA, 10 bp, Saccharomyces cerevisiae
attcttgaga

SEQ ID NO: 7061 - DNA, 10 bp, Saccharomyces cerevisiae
attcttgatt

SEQ ID NO: 7062 - DNA, 10 bp, Saccharomyces cerevisiae
attcttgcct

SEQ ID NO: 7063 - DNA, 10 bp, Saccharomyces cerevisiae
attcttggca

SEQ ID NO: 7064 - DNA, 10 bp, Saccharomyces cerevisiae
attcttgtct

SEQ ID NO: 7065 - DNA, 10 bp, Saccharomyces cerevisiae
attctttcaa

SEQ ID NO: 7066 - DNA, 10 bp, Saccharomyces cerevisiae
attctttcga

SEQ ID NO: 7067 - DNA, 10 bp, Saccharomyces cerevisiae
attctttttt

SEQ ID NO: 7068 - DNA, 10 bp, Saccharomyces cerevisiae
attgaaatgg

SEQ ID NO: 7069 - DNA, 10 bp, Saccharomyces cerevisiae
attgaatgtt

SEQ ID NO: 7070 - DNA, 10 bp, Saccharomyces cerevisiae
attgacgaat

SEQ ID NO: 7071 - DNA, 10 bp, Saccharomyces cerevisiae
attgagagaa

SEQ ID NO: 7072 - DNA, 10 bp, Saccharomyces cerevisiae
attgatattt

SEQ ID NO: 7073 - DNA, 10 bp, Saccharomyces cerevisiae
attgattcaa

SEQ ID NO: 7074 - DNA, 10 bp, Saccharomyces cerevisiae
attgattcgg

SEQ ID NO: 7075 - DNA, 10 bp, Saccharomyces cerevisiae
attgcccgta

SEQ ID NO: 7076 - DNA, 10 bp, Saccharomyces cerevisiae
attgccgagt

SEQ ID NO: 7077 - DNA, 10 bp, Saccharomyces cerevisiae
attgccgctc

SEQ ID NO: 7078 - DNA, 10 bp, Saccharomyces cerevisiae
attgcgtttt

SEQ ID NO: 7079 - DNA, 10 bp, Saccharomyces cerevisiae
attgctaatc

SEQ ID NO: 7080 - DNA, 10 bp, Saccharomyces cerevisiae
attgctccaa

SEQ ID NO: 7081 - DNA, 10 bp, Saccharomyces cerevisiae
attgctgcat

SEQ ID NO: 7082 - DNA, 10 bp, Saccharomyces cerevisiae
attgcttagg

SEQ ID NO: 7083 - DNA, 10 bp, Saccharomyces cerevisiae
attggaacgt

SEQ ID NO: 7084 - DNA, 10 bp, Saccharomyces cerevisiae
attggatgtt

SEQ ID NO: 7085 - DNA, 10 bp, Saccharomyces cerevisiae
attgggaaac

SEQ ID NO: 7086 - DNA, 10 bp, Saccharomyces cerevisiae
attgggaaga

SEQ ID NO: 7087 - DNA, 10 bp, Saccharomyces cerevisiae
attgggagac

SEQ ID NO: 7088 - DNA, 10 bp, Saccharomyces cerevisiae
attgggtgac

SEQ ID NO: 7089 - DNA, 10 bp, Saccharomyces cerevisiae
attgggttgg

SEQ ID NO: 7090 - DNA, 10 bp, Saccharomyces cerevisiae
attggtagtc

SEQ ID NO: 7091 - DNA, 10 bp, Saccharomyces cerevisiae
attggtctgg

SEQ ID NO: 7092 - DNA, 10 bp, Saccharomyces cerevisiae
attggttttt

SEQ ID NO: 7093 - DNA, 10 bp, Saccharomyces cerevisiae
attgtaaacg

SEQ ID NO: 7094 - DNA, 10 bp, Saccharomyces cerevisiae
attgtaaggt

SEQ ID NO: 7095 - DNA, 10 bp, Saccharomyces cerevisiae
attgtagatg

SEQ ID NO: 7096 - DNA, 10 bp, Saccharomyces cerevisiae
attgtagttt

SEQ ID NO: 7097 - DNA, 10 bp, Saccharomyces cerevisiae
attgtcgtgg

SEQ ID NO: 7098 - DNA, 10 bp, Saccharomyces cerevisiae
attgtcttga

SEQ ID NO: 7099 - DNA, 10 bp, Saccharomyces cerevisiae
attgtggtag

SEQ ID NO: 7100 - DNA, 10 bp, Saccharomyces cerevisiae
attgttagaa

SEQ ID NO: 7101 - DNA, 10 bp, Saccharomyces cerevisiae
attgttcctt

SEQ ID NO: 7102 - DNA, 10 bp, Saccharomyces cerevisiae
attgttgttt

SEQ ID NO: 7103 - DNA, 10 bp, Saccharomyces cerevisiae
attgtttgtc

SEQ ID NO: 7104 - DNA, 10 bp, Saccharomyces cerevisiae
atttaatgtt

SEQ ID NO: 7105 - DNA, 10 bp, Saccharomyces cerevisiae
atttacgtga

SEQ ID NO: 7106 - DNA, 10 bp, Saccharomyces cerevisiae
atttactctg

SEQ ID NO: 7107 - DNA, 10 bp, Saccharomyces cerevisiae
atttagttaa

SEQ ID NO: 7108 - DNA, 10 bp, Saccharomyces cerevisiae
atttatcaaa

SEQ ID NO: 7109 - DNA, 10 bp, Saccharomyces cerevisiae
atttatgatt

SEQ ID NO: 7110 - DNA, 10 bp, Saccharomyces cerevisiae
atttatgttg

SEQ ID NO: 7111 - DNA, 10 bp, Saccharomyces cerevisiae
atttattaat

SEQ ID NO: 7112 - DNA, 10 bp, Saccharomyces cerevisiae
atttattttt

SEQ ID NO: 7113 - DNA, 10 bp, Saccharomyces cerevisiae
atttcaaaaa

SEQ ID NO: 7114 - DNA, 10 bp, Saccharomyces cerevisiae
atttcaacgg

SEQ ID NO: 7115 - DNA, 10 bp, Saccharomyces cerevisiae
atttcaatca

SEQ ID NO: 7116 - DNA, 10 bp, Saccharomyces cerevisiae
atttcaatgg

SEQ ID NO: 7117 - DNA, 10 bp, Saccharomyces cerevisiae
atttcaccaa

SEQ ID NO: 7118 - DNA, 10 bp, Saccharomyces cerevisiae
atttcatccc

SEQ ID NO: 7119 - DNA, 10 bp, Saccharomyces cerevisiae
atttccccag

SEQ ID NO: 7120 - DNA, 10 bp, Saccharomyces cerevisiae
atttccgatg

SEQ ID NO: 7121 - DNA, 10 bp, Saccharomyces cerevisiae
atttcctgag

SEQ ID NO: 7122 - DNA, 10 bp, Saccharomyces cerevisiae
atttctcttc

SEQ ID NO: 7123 - DNA, 10 bp, Saccharomyces cerevisiae
atttcttagg

SEQ ID NO: 7124 - DNA, 10 bp, Saccharomyces cerevisiae
atttcttcaa

SEQ ID NO: 7125 - DNA, 10 bp, Saccharomyces cerevisiae
atttcttgaa

SEQ ID NO: 7126 - DNA, 10 bp, Saccharomyces cerevisiae
atttctttga

SEQ ID NO: 7127 - DNA, 10 bp, Saccharomyces cerevisiae
atttgaaaaa

SEQ ID NO: 7128 - DNA, 10 bp, Saccharomyces cerevisiae
atttgatatc

SEQ ID NO: 7129 - DNA, 10 bp, Saccharomyces cerevisiae
atttgatgag

SEQ ID NO: 7130 - DNA, 10 bp, Saccharomyces cerevisiae
atttgatgca

SEQ ID NO: 7131 - DNA, 10 bp, Saccharomyces cerevisiae
atttgattct

SEQ ID NO: 7132 - DNA, 10 bp, Saccharomyces cerevisiae
atttggacgg

SEQ ID NO: 7133 - DNA, 10 bp, Saccharomyces cerevisiae
atttggtaga

SEQ ID NO: 7134 - DNA, 10 bp, Saccharomyces cerevisiae
atttgtagaa

SEQ ID NO: 7135 - DNA, 10 bp, Saccharomyces cerevisiae
atttgtcagc

SEQ ID NO: 7136 - DNA, 10 bp, Saccharomyces cerevisiae
atttgtttga

SEQ ID NO: 7137 - DNA, 10 bp, Saccharomyces cerevisiae
attttaaaaa

SEQ ID NO: 7138 - DNA, 10 bp, Saccharomyces cerevisiae
attttaagtt

SEQ ID NO: 7139 - DNA, 10 bp, Saccharomyces cerevisiae
attttacagc

SEQ ID NO: 7140 - DNA, 10 bp, Saccharomyces cerevisiae
attttagaac

SEQ ID NO: 7141 - DNA, 10 bp, Saccharomyces cerevisiae
attttagtag

SEQ ID NO: 7142 - DNA, 10 bp, Saccharomyces cerevisiae
attttagtct

SEQ ID NO: 7143 - DNA, 10 bp, Saccharomyces cerevisiae
attttagtta

SEQ ID NO: 7144 - DNA, 10 bp, Saccharomyces cerevisiae
attttattca

SEQ ID NO: 7145 - DNA, 10 bp, Saccharomyces cerevisiae
attttattgt

SEQ ID NO: 7146 - DNA, 10 bp, Saccharomyces cerevisiae
attttcaaat

SEQ ID NO: 7147 - DNA, 10 bp, Saccharomyces cerevisiae
attttctctt

SEQ ID NO: 7148 - DNA, 10 bp, Saccharomyces cerevisiae
attttcttca

SEQ ID NO: 7149 - DNA, 10 bp, Saccharomyces cerevisiae
attttcttga

SEQ ID NO: 7150 - DNA, 10 bp, Saccharomyces cerevisiae
attttctttt

SEQ ID NO: 7151 - DNA, 10 bp, Saccharomyces cerevisiae
attttgaagg

SEQ ID NO: 7152 - DNA, 10 bp, Saccharomyces cerevisiae
attttgagaa

SEQ ID NO: 7153 - DNA, 10 bp, Saccharomyces cerevisiae
attttgatac

SEQ ID NO: 7154 - DNA, 10 bp, Saccharomyces cerevisiae
attttggaat

SEQ ID NO: 7155 - DNA, 10 bp, Saccharomyces cerevisiae
attttggctg

SEQ ID NO: 7156 - DNA, 10 bp, Saccharomyces cerevisiae
attttgtatc

SEQ ID NO: 7157 - DNA, 10 bp, Saccharomyces cerevisiae
attttgttta

SEQ ID NO: 7158 - DNA, 10 bp, Saccharomyces cerevisiae
atttttacgc

SEQ ID NO: 7159 - DNA, 10 bp, Saccharomyces cerevisiae
atttttgcga

SEQ ID NO: 7160 - DNA, 10 bp, Saccharomyces cerevisiae
atttttggca

SEQ ID NO: 7161 - DNA, 10 bp, Saccharomyces cerevisiae
atttttgtta

SEQ ID NO: 7162 - DNA, 10 bp, Saccharomyces cerevisiae
caaaaaaccg

SEQ ID NO: 7163 - DNA, 10 bp, Saccharomyces cerevisiae
caaaaaatta

SEQ ID NO: 7164 - DNA, 10 bp, Saccharomyces cerevisiae
caaaaacaac

SEQ ID NO: 7165 - DNA, 10 bp, Saccharomyces cerevisiae
caaaaacgaa

SEQ ID NO: 7166 - DNA, 10 bp, Saccharomyces cerevisiae
caaaacaaca

SEQ ID NO: 7167 - DNA, 10 bp, Saccharomyces cerevisiae
caaaaccatc

SEQ ID NO: 7168 - DNA, 10 bp, Saccharomyces cerevisiae
caaaacccag

SEQ ID NO: 7169 - DNA, 10 bp, Saccharomyces cerevisiae
caaaacccat

SEQ ID NO: 7170 - DNA, 10 bp, Saccharomyces cerevisiae
caaaagacgt

SEQ ID NO: 7171 - DNA, 10 bp, Saccharomyces cerevisiae
caaaagattt

SEQ ID NO: 7172 - DNA, 10 bp, Saccharomyces cerevisiae
caaaagcctg

SEQ ID NO: 7173 - DNA, 10 bp, Saccharomyces cerevisiae
caaaataccg

SEQ ID NO: 7174 - DNA, 10 bp, Saccharomyces cerevisiae
caaaatagat

SEQ ID NO: 7175 - DNA, 10 bp, Saccharomyces cerevisiae
caaaatggat

SEQ ID NO: 7176 - DNA, 10 bp, Saccharomyces cerevisiae
caaaatggct

SEQ ID NO: 7177 - DNA, 10 bp, Saccharomyces cerevisiae
caaaatttcc

SEQ ID NO: 7178 - DNA, 10 bp, Saccharomyces cerevisiae
caaacattta

SEQ ID NO: 7179 - DNA, 10 bp, Saccharomyces cerevisiae
caaacccagc

SEQ ID NO: 7180 - DNA, 10 bp, Saccharomyces cerevisiae
caaaccgact

SEQ ID NO: 7181 - DNA, 10 bp, Saccharomyces cerevisiae
caaactgatt

SEQ ID NO: 7182 - DNA, 10 bp, Saccharomyces cerevisiae
caaactgggt

SEQ ID NO: 7183 - DNA, 10 bp, Saccharomyces cerevisiae
caaagacttc

SEQ ID NO: 7184 - DNA, 10 bp, Saccharomyces cerevisiae
caaagagggg

SEQ ID NO: 7185 - DNA, 10 bp, Saccharomyces cerevisiae
caaagagtca

SEQ ID NO: 7186 - DNA, 10 bp, Saccharomyces cerevisiae
caaagcaaat

SEQ ID NO: 7187 - DNA, 10 bp, Saccharomyces cerevisiae
caaagcatta

SEQ ID NO: 7188 - DNA, 10 bp, Saccharomyces cerevisiae
caaagcccaa

SEQ ID NO: 7189 - DNA, 10 bp, Saccharomyces cerevisiae
caaagcctgc

SEQ ID NO: 7190 - DNA, 10 bp, Saccharomyces cerevisiae
caaaggaaaa

SEQ ID NO: 7191 - DNA, 10 bp, Saccharomyces cerevisiae
caaaggaccg

SEQ ID NO: 7192 - DNA, 10 bp, Saccharomyces cerevisiae
caaaggacct

SEQ ID NO: 7193 - DNA, 10 bp, Saccharomyces cerevisiae
caaaggacta

SEQ ID NO: 7194 - DNA, 10 bp, Saccharomyces cerevisiae
caaaggattt

SEQ ID NO: 7195 - DNA, 10 bp, Saccharomyces cerevisiae
caaaggtcgt

SEQ ID NO: 7196 - DNA, 10 bp, Saccharomyces cerevisiae
caaaggtgcg

SEQ ID NO: 7197 - DNA, 10 bp, Saccharomyces cerevisiae
caaagtcata

SEQ ID NO: 7198 - DNA, 10 bp, Saccharomyces cerevisiae
caaagtcctt

SEQ ID NO: 7199 - DNA, 10 bp, Saccharomyces cerevisiae
caaagtcgac

SEQ ID NO: 7200 - DNA, 10 bp, Saccharomyces cerevisiae
caaagtggct

SEQ ID NO: 7201 - DNA, 10 bp, Saccharomyces cerevisiae
caaagttgaa

SEQ ID NO: 7202 - DNA, 10 bp, Saccharomyces cerevisiae
caaagtttta

SEQ ID NO: 7203 - DNA, 10 bp, Saccharomyces cerevisiae
caaatatatt

SEQ ID NO: 7204 - DNA, 10 bp, Saccharomyces cerevisiae
caaatctgga

SEQ ID NO: 7205 - DNA, 10 bp, Saccharomyces cerevisiae
caaatctttg

SEQ ID NO: 7206 - DNA, 10 bp, Saccharomyces cerevisiae
caaatgctgt

SEQ ID NO: 7207 - DNA, 10 bp, Saccharomyces cerevisiae
caaattcaag

SEQ ID NO: 7208 - DNA, 10 bp, Saccharomyces cerevisiae
caaattctaa

SEQ ID NO: 7209 - DNA, 10 bp, Saccharomyces cerevisiae
caaatttaat

SEQ ID NO: 7210 - DNA, 10 bp, Saccharomyces cerevisiae
caaatttgga

SEQ ID NO: 7211 - DNA, 10 bp, Saccharomyces cerevisiae
caaatttggt

SEQ ID NO: 7212 - DNA, 10 bp, Saccharomyces cerevisiae
caacaaaaga

SEQ ID NO: 7213 - DNA, 10 bp, Saccharomyces cerevisiae
caacaagcca

SEQ ID NO: 7214 - DNA, 10 bp, Saccharomyces cerevisiae
caacaattac

SEQ ID NO: 7215 - DNA, 10 bp, Saccharomyces cerevisiae
caacaattgg

SEQ ID NO: 7216 - DNA, 10 bp, Saccharomyces cerevisiae
caacacgggt

SEQ ID NO: 7217 - DNA, 10 bp, Saccharomyces cerevisiae
caacactgaa

SEQ ID NO: 7218 - DNA, 10 bp, Saccharomyces cerevisiae
caaccaagca

SEQ ID NO: 7219 - DNA, 10 bp, Saccharomyces cerevisiae
caaccagctt

SEQ ID NO: 7220 - DNA, 10 bp, Saccharomyces cerevisiae
caacccaact

SEQ ID NO: 7221 - DNA, 10 bp, Saccharomyces cerevisiae
caacccaata

SEQ ID NO: 7222 - DNA, 10 bp, Saccharomyces cerevisiae
caaccgctta

SEQ ID NO: 7223 - DNA, 10 bp, Saccharomyces cerevisiae
caacctgtat

SEQ ID NO: 7224 - DNA, 10 bp, Saccharomyces cerevisiae
caacgctttt

SEQ ID NO: 7225 - DNA, 10 bp, Saccharomyces cerevisiae
caacgtccgt

SEQ ID NO: 7226 - DNA, 10 bp, Saccharomyces cerevisiae
caacgtctcc

SEQ ID NO: 7227 - DNA, 10 bp, Saccharomyces cerevisiae
caacgtcttt

SEQ ID NO: 7228 - DNA, 10 bp, Saccharomyces cerevisiae
caactatatt

SEQ ID NO: 7229 - DNA, 10 bp, Saccharomyces cerevisiae
caacttactc

SEQ ID NO: 7230 - DNA, 10 bp, Saccharomyces cerevisiae
caacttctcc

SEQ ID NO: 7231 - DNA, 10 bp, Saccharomyces cerevisiae
caacttgagg

SEQ ID NO: 7232 - DNA, 10 bp, Saccharomyces cerevisiae
caactttatc

SEQ ID NO: 7233 - DNA, 10 bp, Saccharomyces cerevisiae
caagaaaaaa

SEQ ID NO: 7234 - DNA, 10 bp, Saccharomyces cerevisiae
caagaaaaat

SEQ ID NO: 7235 - DNA, 10 bp, Saccharomyces cerevisiae
caagaaaata

SEQ ID NO: 7236 - DNA, 10 bp, Saccharomyces cerevisiae
caagaagcgg

SEQ ID NO: 7237 - DNA, 10 bp, Saccharomyces cerevisiae
caagaataaa

SEQ ID NO: 7238 - DNA, 10 bp, Saccharomyces cerevisiae
caagagagga

SEQ ID NO: 7239 - DNA, 10 bp, Saccharomyces cerevisiae
caagagctcc

SEQ ID NO: 7240 - DNA, 10 bp, Saccharomyces cerevisiae
caagagtatc

SEQ ID NO: 7241 - DNA, 10 bp, Saccharomyces cerevisiae
caagagtgca

SEQ ID NO: 7242 - DNA, 10 bp, Saccharomyces cerevisiae
caagatggct

SEQ ID NO: 7243 - DNA, 10 bp, Saccharomyces cerevisiae
caagcacgcc

SEQ ID NO: 7244 - DNA, 10 bp, Saccharomyces cerevisiae
caagccgccg

SEQ ID NO: 7245 - DNA, 10 bp, Saccharomyces cerevisiae
caaggagcta

SEQ ID NO: 7246 - DNA, 10 bp, Saccharomyces cerevisiae
caaggcggct

SEQ ID NO: 7247 - DNA, 10 bp, Saccharomyces cerevisiae
caagggaata

SEQ ID NO: 7248 - DNA, 10 bp, Saccharomyces cerevisiae
caagggataa

SEQ ID NO: 7249 - DNA, 10 bp, Saccharomyces cerevisiae
caagtatata

SEQ ID NO: 7250 - DNA, 10 bp, Saccharomyces cerevisiae
caagtattga

SEQ ID NO: 7251 - DNA, 10 bp, Saccharomyces cerevisiae
caagtctgga

SEQ ID NO: 7252 - DNA, 10 bp, Saccharomyces cerevisiae
caataaaaca

SEQ ID NO: 7253 - DNA, 10 bp, Saccharomyces cerevisiae
caataaaatt

SEQ ID NO: 7254 - DNA, 10 bp, Saccharomyces cerevisiae
caataatcgg

SEQ ID NO: 7255 - DNA, 10 bp, Saccharomyces cerevisiae
caataatggg

SEQ ID NO: 7256 - DNA, 10 bp, Saccharomyces cerevisiae
caatacgtcg

SEQ ID NO: 7257 - DNA, 10 bp, Saccharomyces cerevisiae
caatatcgaa

SEQ ID NO: 7258 - DNA, 10 bp, Saccharomyces cerevisiae
caatatttga

SEQ ID NO: 7259 - DNA, 10 bp, Saccharomyces cerevisiae
caatcaaaaa

SEQ ID NO: 7260 - DNA, 10 bp, Saccharomyces cerevisiae
caatcatctg

SEQ ID NO: 7261 - DNA, 10 bp, Saccharomyces cerevisiae
caatccactt

SEQ ID NO: 7262 - DNA, 10 bp, Saccharomyces cerevisiae
caatcgccgg

SEQ ID NO: 7263 - DNA, 10 bp, Saccharomyces cerevisiae
caatcgtggt

SEQ ID NO: 7264 - DNA, 10 bp, Saccharomyces cerevisiae
caatctcagg

SEQ ID NO: 7265 - DNA, 10 bp, Saccharomyces cerevisiae
caatctgaca

SEQ ID NO: 7266 - DNA, 10 bp, Saccharomyces cerevisiae
caatgaaaaa

SEQ ID NO: 7267 - DNA, 10 bp, Saccharomyces cerevisiae
caatgattga

SEQ ID NO: 7268 - DNA, 10 bp, Saccharomyces cerevisiae
caatgcaatt

SEQ ID NO: 7269 - DNA, 10 bp, Saccharomyces cerevisiae
caatgctgag

SEQ ID NO: 7270 - DNA, 10 bp, Saccharomyces cerevisiae
caatggaccg

SEQ ID NO: 7271 - DNA, 10 bp, Saccharomyces cerevisiae
caatggccag

SEQ ID NO: 7272 - DNA, 10 bp, Saccharomyces cerevisiae
caatggttcc

SEQ ID NO: 7273 - DNA, 10 bp, Saccharomyces cerevisiae
caatgtgcat

SEQ ID NO: 7274 - DNA, 10 bp, Saccharomyces cerevisiae
caatgtttac

SEQ ID NO: 7275 - DNA, 10 bp, Saccharomyces cerevisiae
caattaaaaa

SEQ ID NO: 7276 - DNA, 10 bp, Saccharomyces cerevisiae
caattatcaa

SEQ ID NO: 7277 - DNA, 10 bp, Saccharomyces cerevisiae
caattctcta

SEQ ID NO: 7278 - DNA, 10 bp, Saccharomyces cerevisiae
caattcttgg

SEQ ID NO: 7279 - DNA, 10 bp, Saccharomyces cerevisiae
caattgatat

SEQ ID NO: 7280 - DNA, 10 bp, Saccharomyces cerevisiae
caattgatct

SEQ ID NO: 7281 - DNA, 10 bp, Saccharomyces cerevisiae
caattgatta

SEQ ID NO: 7282 - DNA, 10 bp, Saccharomyces cerevisiae
caatttaaat

SEQ ID NO: 7283 - DNA, 10 bp, Saccharomyces cerevisiae
caatttagcg

SEQ ID NO: 7284 - DNA, 10 bp, Saccharomyces cerevisiae
caatttgtgt

SEQ ID NO: 7285 - DNA, 10 bp, Saccharomyces cerevisiae
caattttggt

SEQ ID NO: 7286 - DNA, 10 bp, Saccharomyces cerevisiae
cacaaaacct

SEQ ID NO: 7287 - DNA, 10 bp, Saccharomyces cerevisiae
cacaaaggga

SEQ ID NO: 7288 - DNA, 10 bp, Saccharomyces cerevisiae
cacaaatttt

SEQ ID NO: 7289 - DNA, 10 bp, Saccharomyces cerevisiae
cacaacccaa

SEQ ID NO: 7290 - DNA, 10 bp, Saccharomyces cerevisiae
cacaagtcta

SEQ ID NO: 7291 - DNA, 10 bp, Saccharomyces cerevisiae
cacacattga

SEQ ID NO: 7292 - DNA, 10 bp, Saccharomyces cerevisiae
cacaccaaaa

SEQ ID NO: 7293 - DNA, 10 bp, Saccharomyces cerevisiae
cacaccaagg

SEQ ID NO: 7294 - DNA, 10 bp, Saccharomyces cerevisiae
cacaccaatt

SEQ ID NO: 7295 - DNA, 10 bp, Saccharomyces cerevisiae
cacaccccga

SEQ ID NO: 7296 - DNA, 10 bp, Saccharomyces cerevisiae
cacacctaga

SEQ ID NO: 7297 - DNA, 10 bp, Saccharomyces cerevisiae
cacactttga

SEQ ID NO: 7298 - DNA, 10 bp, Saccharomyces cerevisiae
cacagaccag

SEQ ID NO: 7299 - DNA, 10 bp, Saccharomyces cerevisiae
cacaggttac

SEQ ID NO: 7300 - DNA, 10 bp, Saccharomyces cerevisiae
cacagtttca

SEQ ID NO: 7301 - DNA, 10 bp, Saccharomyces cerevisiae
cacagtttcc

SEQ ID NO: 7302 - DNA, 10 bp, Saccharomyces cerevisiae
cacataaaaa

SEQ ID NO: 7303 - DNA, 10 bp, Saccharomyces cerevisiae
cacataagga

SEQ ID NO: 7304 - DNA, 10 bp, Saccharomyces cerevisiae
cacatagaag

SEQ ID NO: 7305 - DNA, 10 bp, Saccharomyces cerevisiae
cacatatata

SEQ ID NO: 7306 - DNA, 10 bp, Saccharomyces cerevisiae
cacatctcag

SEQ ID NO: 7307 - DNA, 10 bp, Saccharomyces cerevisiae
cacatttttc

SEQ ID NO: 7308 - DNA, 10 bp, Saccharomyces cerevisiae
cacatttttt

SEQ ID NO: 7309 - DNA, 10 bp, Saccharomyces cerevisiae
caccaaaaaa

SEQ ID NO: 7310 - DNA, 10 bp, Saccharomyces cerevisiae
caccaaagaa

SEQ ID NO: 7311 - DNA, 10 bp, Saccharomyces cerevisiae
caccaaaggc

SEQ ID NO: 7312 - DNA, 10 bp, Saccharomyces cerevisiae
caccaactac

SEQ ID NO: 7313 - DNA, 10 bp, Saccharomyces cerevisiae
caccaagcgt

SEQ ID NO: 7314 - DNA, 10 bp, Saccharomyces cerevisiae
caccatcgaa

SEQ ID NO: 7315 - DNA, 10 bp, Saccharomyces cerevisiae
cacccaccag

SEQ ID NO: 7316 - DNA, 10 bp, Saccharomyces cerevisiae
cacccagatt

SEQ ID NO: 7317 - DNA, 10 bp, Saccharomyces cerevisiae
cacccgccag

SEQ ID NO: 7318 - DNA, 10 bp, Saccharomyces cerevisiae
caccgaaagc

SEQ ID NO: 7319 - DNA, 10 bp, Saccharomyces cerevisiae
caccgcgaag

SEQ ID NO: 7320 - DNA, 10 bp, Saccharomyces cerevisiae
caccgtaaaa

SEQ ID NO: 7321 - DNA, 10 bp, Saccharomyces cerevisiae
cacctcaagg

SEQ ID NO: 7322 - DNA, 10 bp, Saccharomyces cerevisiae
caccttcaat

SEQ ID NO: 7323 - DNA, 10 bp, Saccharomyces cerevisiae
cacgaaaaaa

SEQ ID NO: 7324 - DNA, 10 bp, Saccharomyces cerevisiae
cacgaagtcg

SEQ ID NO: 7325 - DNA, 10 bp, Saccharomyces cerevisiae
cacgactact

SEQ ID NO: 7326 - DNA, 10 bp, Saccharomyces cerevisiae
cacgatcgaa

SEQ ID NO: 7327 - DNA, 10 bp, Saccharomyces cerevisiae
cacgatttga

SEQ ID NO: 7328 - DNA, 10 bp, Saccharomyces cerevisiae
cacggaaagc

SEQ ID NO: 7329 - DNA, 10 bp, Saccharomyces cerevisiae
cacggcgccg

SEQ ID NO: 7330 - DNA, 10 bp, Saccharomyces cerevisiae
cacgtaaggg

SEQ ID NO: 7331 - DNA, 10 bp, Saccharomyces cerevisiae
cacgtccaca

SEQ ID NO: 7332 - DNA, 10 bp, Saccharomyces cerevisiae
cacgtttctg

SEQ ID NO: 7333 - DNA, 10 bp, Saccharomyces cerevisiae
cactaaactg

SEQ ID NO: 7334 - DNA, 10 bp, Saccharomyces cerevisiae
cactaacaag

SEQ ID NO: 7335 - DNA, 10 bp, Saccharomyces cerevisiae
cactaaccat

SEQ ID NO: 7336 - DNA, 10 bp, Saccharomyces cerevisiae
cactaataaa

SEQ ID NO: 7337 - DNA, 10 bp, Saccharomyces cerevisiae
cactagtttc

SEQ ID NO: 7338 - DNA, 10 bp, Saccharomyces cerevisiae
cactatcatc

SEQ ID NO: 7339 - DNA, 10 bp, Saccharomyces cerevisiae
cactcaacaa

SEQ ID NO: 7340 - DNA, 10 bp, Saccharomyces cerevisiae
cactcaccca

SEQ ID NO: 7341 - DNA, 10 bp, Saccharomyces cerevisiae
cactccaaga

SEQ ID NO: 7342 - DNA, 10 bp, Saccharomyces cerevisiae
cactccggcc

SEQ ID NO: 7343 - DNA, 10 bp, Saccharomyces cerevisiae
cactcggggc

SEQ ID NO: 7344 - DNA, 10 bp, Saccharomyces cerevisiae
cactctgggc

SEQ ID NO: 7345 - DNA, 10 bp, Saccharomyces cerevisiae
cactgctgat

SEQ ID NO: 7346 - DNA, 10 bp, Saccharomyces cerevisiae
cactgcttaa

SEQ ID NO: 7347 - DNA, 10 bp, Saccharomyces cerevisiae
cactggagtt

SEQ ID NO: 7348 - DNA, 10 bp, Saccharomyces cerevisiae
cactgtcccc

SEQ ID NO: 7349 - DNA, 10 bp, Saccharomyces cerevisiae
cactgtttat

SEQ ID NO: 7350 - DNA, 10 bp, Saccharomyces cerevisiae
cacttcaacg

SEQ ID NO: 7351 - DNA, 10 bp, Saccharomyces cerevisiae
cacttccaca

SEQ ID NO: 7352 - DNA, 10 bp, Saccharomyces cerevisiae
cacttcgaca

SEQ ID NO: 7353 - DNA, 10 bp, Saccharomyces cerevisiae
cacttcgact

SEQ ID NO: 7354 - DNA, 10 bp, Saccharomyces cerevisiae
cacttctggc

SEQ ID NO: 7355 - DNA, 10 bp, Saccharomyces cerevisiae
cacttcttaa

SEQ ID NO: 7356 - DNA, 10 bp, Saccharomyces cerevisiae
cacttgaaaa

SEQ ID NO: 7357 - DNA, 10 bp, Saccharomyces cerevisiae
cacttgaagc

SEQ ID NO: 7358 - DNA, 10 bp, Saccharomyces cerevisiae
cacttgagtc

SEQ ID NO: 7359 - DNA, 10 bp, Saccharomyces cerevisiae
cactttaaaa

SEQ ID NO: 7360 - DNA, 10 bp, Saccharomyces cerevisiae
cactttttat

SEQ ID NO: 7361 - DNA, 10 bp, Saccharomyces cerevisiae
cagaaaagtt

SEQ ID NO: 7362 - DNA, 10 bp, Saccharomyces cerevisiae
cagaaacaaa

SEQ ID NO: 7363 - DNA, 10 bp, Saccharomyces cerevisiae
cagaagaagg

SEQ ID NO: 7364 - DNA, 10 bp, Saccharomyces cerevisiae
cagaagagat

SEQ ID NO: 7365 - DNA, 10 bp, Saccharomyces cerevisiae
cagaagctca

SEQ ID NO: 7366 - DNA, 10 bp, Saccharomyces cerevisiae
cagaatatgc

SEQ ID NO: 7367 - DNA, 10 bp, Saccharomyces cerevisiae
cagaatgaat

SEQ ID NO: 7368 - DNA, 10 bp, Saccharomyces cerevisiae
cagaatgatg

SEQ ID NO: 7369 - DNA, 10 bp, Saccharomyces cerevisiae
cagacaaact

SEQ ID NO: 7370 - DNA, 10 bp, Saccharomyces cerevisiae
cagacacaca

SEQ ID NO: 7371 - DNA, 10 bp, Saccharomyces cerevisiae
cagacgaagt

SEQ ID NO: 7372 - DNA, 10 bp, Saccharomyces cerevisiae
cagagccaaa

SEQ ID NO: 7373 - DNA, 10 bp, Saccharomyces cerevisiae
cagaggcgtt

SEQ ID NO: 7374 - DNA, 10 bp, Saccharomyces cerevisiae
cagagttggt

SEQ ID NO: 7375 - DNA, 10 bp, Saccharomyces cerevisiae
cagatacaga

SEQ ID NO: 7376 - DNA, 10 bp, Saccharomyces cerevisiae
cagatattga

SEQ ID NO: 7377 - DNA, 10 bp, Saccharomyces cerevisiae
cagatctatt

SEQ ID NO: 7378 - DNA, 10 bp, Saccharomyces cerevisiae
cagatctgag

SEQ ID NO: 7379 - DNA, 10 bp, Saccharomyces cerevisiae
cagatggggg

SEQ ID NO: 7380 - DNA, 10 bp, Saccharomyces cerevisiae
cagatggtcc

SEQ ID NO: 7381 - DNA, 10 bp, Saccharomyces cerevisiae
cagatttcaa

SEQ ID NO: 7382 - DNA, 10 bp, Saccharomyces cerevisiae
cagatttctc

SEQ ID NO: 7383 - DNA, 10 bp, Saccharomyces cerevisiae
cagatttttg

SEQ ID NO: 7384 - DNA, 10 bp, Saccharomyces cerevisiae
cagcaaaact

SEQ ID NO: 7385 - DNA, 10 bp, Saccharomyces cerevisiae
cagcaaaaga

SEQ ID NO: 7386 - DNA, 10 bp, Saccharomyces cerevisiae
cagcagattg

SEQ ID NO: 7387 - DNA, 10 bp, Saccharomyces cerevisiae
cagcagcaaa

SEQ ID NO: 7388 - DNA, 10 bp, Saccharomyces cerevisiae
cagcaggttc

SEQ ID NO: 7389 - DNA, 10 bp, Saccharomyces cerevisiae
cagccaaaaa

SEQ ID NO: 7390 - DNA, 10 bp, Saccharomyces cerevisiae
cagccaaata

SEQ ID NO: 7391 - DNA, 10 bp, Saccharomyces cerevisiae
cagccaagac

SEQ ID NO: 7392 - DNA, 10 bp, Saccharomyces cerevisiae
cagccgcttt

SEQ ID NO: 7393 - DNA, 10 bp, Saccharomyces cerevisiae
cagccgggtc

SEQ ID NO: 7394 - DNA, 10 bp, Saccharomyces cerevisiae
cagccttaaa

SEQ ID NO: 7395 - DNA, 10 bp, Saccharomyces cerevisiae
cagcgcaggc

SEQ ID NO: 7396 - DNA, 10 bp, Saccharomyces cerevisiae
cagcggaccc

SEQ ID NO: 7397 - DNA, 10 bp, Saccharomyces cerevisiae
cagcggtggt

SEQ ID NO: 7398 - DNA, 10 bp, Saccharomyces cerevisiae
cagctaaccg

SEQ ID NO: 7399 - DNA, 10 bp, Saccharomyces cerevisiae
cagctaagga

SEQ ID NO: 7400 - DNA, 10 bp, Saccharomyces cerevisiae
cagctaaggc

SEQ ID NO: 7401 - DNA, 10 bp, Saccharomyces cerevisiae
cagctctcac

SEQ ID NO: 7402 - DNA, 10 bp, Saccharomyces cerevisiae
cagctgaccg

SEQ ID NO: 7403 - DNA, 10 bp, Saccharomyces cerevisiae
cagctttatc

SEQ ID NO: 7404 - DNA, 10 bp, Saccharomyces cerevisiae
cagctttctt

SEQ ID NO: 7405 - DNA, 10 bp, Saccharomyces cerevisiae
cagcttttaa

SEQ ID NO: 7406 - DNA, 10 bp, Saccharomyces cerevisiae
caggaaatgg

SEQ ID NO: 7407 - DNA, 10 bp, Saccharomyces cerevisiae
caggaagcag

SEQ ID NO: 7408 - DNA, 10 bp, Saccharomyces cerevisiae
caggaataaa

SEQ ID NO: 7409 - DNA, 10 bp, Saccharomyces cerevisiae
caggaatgct

SEQ ID NO: 7410 - DNA, 10 bp, Saccharomyces cerevisiae
caggaccatc

SEQ ID NO: 7411 - DNA, 10 bp, Saccharomyces cerevisiae
caggagagat

SEQ ID NO: 7412 - DNA, 10 bp, Saccharomyces cerevisiae
caggatgttg

SEQ ID NO: 7413 - DNA, 10 bp, Saccharomyces cerevisiae
caggcactaa

SEQ ID NO: 7414 - DNA, 10 bp, Saccharomyces cerevisiae
caggccagtt

SEQ ID NO: 7415 - DNA, 10 bp, Saccharomyces cerevisiae
caggctcatc

SEQ ID NO: 7416 - DNA, 10 bp, Saccharomyces cerevisiae
cagggagtct

SEQ ID NO: 7417 - DNA, 10 bp, Saccharomyces cerevisiae
cagggatcga

SEQ ID NO: 7418 - DNA, 10 bp, Saccharomyces cerevisiae
cagggtaaaa

SEQ ID NO: 7419 - DNA, 10 bp, Saccharomyces cerevisiae
caggtaggca

SEQ ID NO: 7420 - DNA, 10 bp, Saccharomyces cerevisiae
caggtctttg

SEQ ID NO: 7421 - DNA, 10 bp, Saccharomyces cerevisiae
caggtgatag

SEQ ID NO: 7422 - DNA, 10 bp, Saccharomyces cerevisiae
caggttctgt

SEQ ID NO: 7423 - DNA, 10 bp, Saccharomyces cerevisiae
caggtttgtt

SEQ ID NO: 7424 - DNA, 10 bp, Saccharomyces cerevisiae
cagtaatact

SEQ ID NO: 7425 - DNA, 10 bp, Saccharomyces cerevisiae
cagtaatatc

SEQ ID NO: 7426 - DNA, 10 bp, Saccharomyces cerevisiae
cagtacaact

SEQ ID NO: 7427 - DNA, 10 bp, Saccharomyces cerevisiae
cagtacaccg

SEQ ID NO: 7428 - DNA, 10 bp, Saccharomyces cerevisiae
cagtagcaaa

SEQ ID NO: 7429 - DNA, 10 bp, Saccharomyces cerevisiae
cagtatctaa

SEQ ID NO: 7430 - DNA, 10 bp, Saccharomyces cerevisiae
cagtgcgaaa

SEQ ID NO: 7431 - DNA, 10 bp, Saccharomyces cerevisiae
cagtggaaca

SEQ ID NO: 7432 - DNA, 10 bp, Saccharomyces cerevisiae
cagttaaatt

SEQ ID NO: 7433 - DNA, 10 bp, Saccharomyces cerevisiae
cagttcttca

SEQ ID NO: 7434 - DNA, 10 bp, Saccharomyces cerevisiae
cagttgattt

SEQ ID NO: 7435 - DNA, 10 bp, Saccharomyces cerevisiae
cataaactct

SEQ ID NO: 7436 - DNA, 10 bp, Saccharomyces cerevisiae
cataaattac

SEQ ID NO: 7437 - DNA, 10 bp, Saccharomyces cerevisiae
cataaccttc

SEQ ID NO: 7438 - DNA, 10 bp, Saccharomyces cerevisiae
cataactcat

SEQ ID NO: 7439 - DNA, 10 bp, Saccharomyces cerevisiae
cataagcaac

SEQ ID NO: 7440 - DNA, 10 bp, Saccharomyces cerevisiae
cataagtttt

SEQ ID NO: 7441 - DNA, 10 bp, Saccharomyces cerevisiae
cataattttc

SEQ ID NO: 7442 - DNA, 10 bp, Saccharomyces cerevisiae
catacgcaca

SEQ ID NO: 7443 - DNA, 10 bp, Saccharomyces cerevisiae
catacgtgta

SEQ ID NO: 7444 - DNA, 10 bp, Saccharomyces cerevisiae
catactctcg

SEQ ID NO: 7445 - DNA, 10 bp, Saccharomyces cerevisiae
catacttcat

SEQ ID NO: 7446 - DNA, 10 bp, Saccharomyces cerevisiae
catacttcga

SEQ ID NO: 7447 - DNA, 10 bp, Saccharomyces cerevisiae
catagccaat

SEQ ID NO: 7448 - DNA, 10 bp, Saccharomyces cerevisiae
catataaagc

SEQ ID NO: 7449 - DNA, 10 bp, Saccharomyces cerevisiae
catataacta

SEQ ID NO: 7450 - DNA, 10 bp, Saccharomyces cerevisiae
catatacatt

SEQ ID NO: 7451 - DNA, 10 bp, Saccharomyces cerevisiae
catatagaat

SEQ ID NO: 7452 - DNA, 10 bp, Saccharomyces cerevisiae
catatagata

SEQ ID NO: 7453 - DNA, 10 bp, Saccharomyces cerevisiae
catatataaa

SEQ ID NO: 7454 - DNA, 10 bp, Saccharomyces cerevisiae
catatctcga

SEQ ID NO: 7455 - DNA, 10 bp, Saccharomyces cerevisiae
catatgtgct

SEQ ID NO: 7456 - DNA, 10 bp, Saccharomyces cerevisiae
catattctgt

SEQ ID NO: 7457 - DNA, 10 bp, Saccharomyces cerevisiae
catatttggg

SEQ ID NO: 7458 - DNA, 10 bp, Saccharomyces cerevisiae
catcaaaaaa

SEQ ID NO: 7459 - DNA, 10 bp, Saccharomyces cerevisiae
catcaaaagt

SEQ ID NO: 7460 - DNA, 10 bp, Saccharomyces cerevisiae
catcaagatt

SEQ ID NO: 7461 - DNA, 10 bp, Saccharomyces cerevisiae
catcaatgga

SEQ ID NO: 7462 - DNA, 10 bp, Saccharomyces cerevisiae
catcacgtac

SEQ ID NO: 7463 - DNA, 10 bp, Saccharomyces cerevisiae
catcactgat

SEQ ID NO: 7464 - DNA, 10 bp, Saccharomyces cerevisiae
catcagaaat

SEQ ID NO: 7465 - DNA, 10 bp, Saccharomyces cerevisiae
catcagctaa

SEQ ID NO: 7466 - DNA, 10 bp, Saccharomyces cerevisiae
catcagctct

SEQ ID NO: 7467 - DNA, 10 bp, Saccharomyces cerevisiae
catcataaac

SEQ ID NO: 7468 - DNA, 10 bp, Saccharomyces cerevisiae
catcattata

SEQ ID NO: 7469 - DNA, 10 bp, Saccharomyces cerevisiae
catcattctt

SEQ ID NO: 7470 - DNA, 10 bp, Saccharomyces cerevisiae
catcatttaa

SEQ ID NO: 7471 - DNA, 10 bp, Saccharomyces cerevisiae
catccaatcc

SEQ ID NO: 7472 - DNA, 10 bp, Saccharomyces cerevisiae
catccattag

SEQ ID NO: 7473 - DNA, 10 bp, Saccharomyces cerevisiae
catccttaat

SEQ ID NO: 7474 - DNA, 10 bp, Saccharomyces cerevisiae
catcgacact

SEQ ID NO: 7475 - DNA, 10 bp, Saccharomyces cerevisiae
catcggtcta

SEQ ID NO: 7476 - DNA, 10 bp, Saccharomyces cerevisiae
catcggtctg

SEQ ID NO: 7477 - DNA, 10 bp, Saccharomyces cerevisiae
catcgttctt

SEQ ID NO: 7478 - DNA, 10 bp, Saccharomyces cerevisiae
catctaagcc

SEQ ID NO: 7479 - DNA, 10 bp, Saccharomyces cerevisiae
catctacaca

SEQ ID NO: 7480 - DNA, 10 bp, Saccharomyces cerevisiae
catctactgg

SEQ ID NO: 7481 - DNA, 10 bp, Saccharomyces cerevisiae
catctaggag

SEQ ID NO: 7482 - DNA, 10 bp, Saccharomyces cerevisiae
catctattcc

SEQ ID NO: 7483 - DNA, 10 bp, Saccharomyces cerevisiae
catctcaaaa

SEQ ID NO: 7484 - DNA, 10 bp, Saccharomyces cerevisiae
catctcatat

SEQ ID NO: 7485 - DNA, 10 bp, Saccharomyces cerevisiae
catctctcaa

SEQ ID NO: 7486 - DNA, 10 bp, Saccharomyces cerevisiae
catctctctt

SEQ ID NO: 7487 - DNA, 10 bp, Saccharomyces cerevisiae
catctggaac

SEQ ID NO: 7488 - DNA, 10 bp, Saccharomyces cerevisiae
catcttatct

SEQ ID NO: 7489 - DNA, 10 bp, Saccharomyces cerevisiae
catctttact

SEQ ID NO: 7490 - DNA, 10 bp, Saccharomyces cerevisiae
catctttttt

SEQ ID NO: 7491 - DNA, 10 bp, Saccharomyces cerevisiae
cattaaaaaa

SEQ ID NO: 7492 - DNA, 10 bp, Saccharomyces cerevisiae
cattaaaagt

SEQ ID NO: 7493 - DNA, 10 bp, Saccharomyces cerevisiae
cattaaagcg

SEQ ID NO: 7494 - DNA, 10 bp, Saccharomyces cerevisiae
cattaagtct

SEQ ID NO: 7495 - DNA, 10 bp, Saccharomyces cerevisiae
cattaatgtt

SEQ ID NO: 7496 - DNA, 10 bp, Saccharomyces cerevisiae
cattagcctt

SEQ ID NO: 7497 - DNA, 10 bp, Saccharomyces cerevisiae
cattaggaac

SEQ ID NO: 7498 - DNA, 10 bp, Saccharomyces cerevisiae
cattattaag

SEQ ID NO: 7499 - DNA, 10 bp, Saccharomyces cerevisiae
cattattgaa

SEQ ID NO: 7500 - DNA, 10 bp, Saccharomyces cerevisiae
cattcaaaat

SEQ ID NO: 7501 - DNA, 10 bp, Saccharomyces cerevisiae
cattcctata

SEQ ID NO: 7502 - DNA, 10 bp, Saccharomyces cerevisiae
cattccttat

SEQ ID NO: 7503 - DNA, 10 bp, Saccharomyces cerevisiae
cattctgggc

SEQ ID NO: 7504 - DNA, 10 bp, Saccharomyces cerevisiae
cattctgttc

SEQ ID NO: 7505 - DNA, 10 bp, Saccharomyces cerevisiae
cattgaagaa

SEQ ID NO: 7506 - DNA, 10 bp, Saccharomyces cerevisiae
cattgagcaa

SEQ ID NO: 7507 - DNA, 10 bp, Saccharomyces cerevisiae
cattgagccg

SEQ ID NO: 7508 - DNA, 10 bp, Saccharomyces cerevisiae
cattgcaagt

SEQ ID NO: 7509 - DNA, 10 bp, Saccharomyces cerevisiae
cattgccatt

SEQ ID NO: 7510 - DNA, 10 bp, Saccharomyces cerevisiae
cattggatgg

SEQ ID NO: 7511 - DNA, 10 bp, Saccharomyces cerevisiae
catttcacca

SEQ ID NO: 7512 - DNA, 10 bp, Saccharomyces cerevisiae
catttctacg

SEQ ID NO: 7513 - DNA, 10 bp, Saccharomyces cerevisiae
catttcttat

SEQ ID NO: 7514 - DNA, 10 bp, Saccharomyces cerevisiae
catttcttct

SEQ ID NO: 7515 - DNA, 10 bp, Saccharomyces cerevisiae
catttcttta

SEQ ID NO: 7516 - DNA, 10 bp, Saccharomyces cerevisiae
catttgaagg

SEQ ID NO: 7517 - DNA, 10 bp, Saccharomyces cerevisiae
catttgatag

SEQ ID NO: 7518 - DNA, 10 bp, Saccharomyces cerevisiae
catttgcagg

SEQ ID NO: 7519 - DNA, 10 bp, Saccharomyces cerevisiae
catttgcgta

SEQ ID NO: 7520 - DNA, 10 bp, Saccharomyces cerevisiae
catttgggtc

SEQ ID NO: 7521 - DNA, 10 bp, Saccharomyces cerevisiae
cattttaccc

SEQ ID NO: 7522 - DNA, 10 bp, Saccharomyces cerevisiae
cattttacct

SEQ ID NO: 7523 - DNA, 10 bp, Saccharomyces cerevisiae
cattttatat

SEQ ID NO: 7524 - DNA, 10 bp, Saccharomyces cerevisiae
cattttcccc

SEQ ID NO: 7525 - DNA, 10 bp, Saccharomyces cerevisiae
catttttcga

SEQ ID NO: 7526 - DNA, 10 bp, Saccharomyces cerevisiae
cattttttgg

SEQ ID NO: 7527 - DNA, 10 bp, Saccharomyces cerevisiae
catttttttc

SEQ ID NO: 7528 - DNA, 10 bp, Saccharomyces cerevisiae
ccaaaaaggg

SEQ ID NO: 7529 - DNA, 10 bp, Saccharomyces cerevisiae
ccaaaacttc

SEQ ID NO: 7530 - DNA, 10 bp, Saccharomyces cerevisiae
ccaaaagggc

SEQ ID NO: 7531 - DNA, 10 bp, Saccharomyces cerevisiae
ccaaaatttg

SEQ ID NO: 7532 - DNA, 10 bp, Saccharomyces cerevisiae
ccaaacaggt

SEQ ID NO: 7533 - DNA, 10 bp, Saccharomyces cerevisiae
ccaaaccgaa

SEQ ID NO: 7534 - DNA, 10 bp, Saccharomyces cerevisiae
ccaaactagg

SEQ ID NO: 7535 - DNA, 10 bp, Saccharomyces cerevisiae
ccaaaggtaa

SEQ ID NO: 7536 - DNA, 10 bp, Saccharomyces cerevisiae
ccaaaggtat

SEQ ID NO: 7537 - DNA, 10 bp, Saccharomyces cerevisiae
ccaaaggtta

SEQ ID NO: 7538 - DNA, 10 bp, Saccharomyces cerevisiae
ccaaagtgcc

SEQ ID NO: 7539 - DNA, 10 bp, Saccharomyces cerevisiae
ccaaagtgga

SEQ ID NO: 7540 - DNA, 10 bp, Saccharomyces cerevisiae
ccaaatagta

SEQ ID NO: 7541 - DNA, 10 bp, Saccharomyces cerevisiae
ccaaatccat

SEQ ID NO: 7542 - DNA, 10 bp, Saccharomyces cerevisiae
ccaaatctgg

SEQ ID NO: 7543 - DNA, 10 bp, Saccharomyces cerevisiae
ccaaatcttt

SEQ ID NO: 7544 - DNA, 10 bp, Saccharomyces cerevisiae
ccaaatgacg

SEQ ID NO: 7545 - DNA, 10 bp, Saccharomyces cerevisiae
ccaaatgcca

SEQ ID NO: 7546 - DNA, 10 bp, Saccharomyces cerevisiae
ccaaattcca

SEQ ID NO: 7547 - DNA, 10 bp, Saccharomyces cerevisiae
ccaacaaatc

SEQ ID NO: 7548 - DNA, 10 bp, Saccharomyces cerevisiae
ccaacgggat

SEQ ID NO: 7549 - DNA, 10 bp, Saccharomyces cerevisiae
ccaacgttaa

SEQ ID NO: 7550 - DNA, 10 bp, Saccharomyces cerevisiae
ccaactaagt

SEQ ID NO: 7551 - DNA, 10 bp, Saccharomyces cerevisiae
ccaactcaaa

SEQ ID NO: 7552 - DNA, 10 bp, Saccharomyces cerevisiae
ccaactggag

SEQ ID NO: 7553 - DNA, 10 bp, Saccharomyces cerevisiae
ccaagaagtt

SEQ ID NO: 7554 - DNA, 10 bp, Saccharomyces cerevisiae
ccaagaattc

SEQ ID NO: 7555 - DNA, 10 bp, Saccharomyces cerevisiae
ccaagagccg

SEQ ID NO: 7556 - DNA, 10 bp, Saccharomyces cerevisiae
ccaagcgtgc

SEQ ID NO: 7557 - DNA, 10 bp, Saccharomyces cerevisiae
ccaaggatat

SEQ ID NO: 7558 - DNA, 10 bp, Saccharomyces cerevisiae
ccaagggcat

SEQ ID NO: 7559 - DNA, 10 bp, Saccharomyces cerevisiae
ccaaggggat

SEQ ID NO: 7560 - DNA, 10 bp, Saccharomyces cerevisiae
ccaagggtaa

SEQ ID NO: 7561 - DNA, 10 bp, Saccharomyces cerevisiae
ccaagggtct

SEQ ID NO: 7562 - DNA, 10 bp, Saccharomyces cerevisiae
ccaaggtatc

SEQ ID NO: 7563 - DNA, 10 bp, Saccharomyces cerevisiae
ccaaggttat

SEQ ID NO: 7564 - DNA, 10 bp, Saccharomyces cerevisiae
ccaaggttct

SEQ ID NO: 7565 - DNA, 10 bp, Saccharomyces cerevisiae
ccaagtactt

SEQ ID NO: 7566 - DNA, 10 bp, Saccharomyces cerevisiae
ccaagtgcta

SEQ ID NO: 7567 - DNA, 10 bp, Saccharomyces cerevisiae
ccaatatttc

SEQ ID NO: 7568 - DNA, 10 bp, Saccharomyces cerevisiae
ccaatcttca

SEQ ID NO: 7569 - DNA, 10 bp, Saccharomyces cerevisiae
ccaatgagca

SEQ ID NO: 7570 - DNA, 10 bp, Saccharomyces cerevisiae
ccaatgcatt

SEQ ID NO: 7571 - DNA, 10 bp, Saccharomyces cerevisiae
ccaatggaaa

SEQ ID NO: 7572 - DNA, 10 bp, Saccharomyces cerevisiae
ccaattaatt

SEQ ID NO: 7573 - DNA, 10 bp, Saccharomyces cerevisiae
ccaattcatt

SEQ ID NO: 7574 - DNA, 10 bp, Saccharomyces cerevisiae
ccaatttttg

SEQ ID NO: 7575 - DNA, 10 bp, Saccharomyces cerevisiae
ccacaaaaaa

SEQ ID NO: 7576 - DNA, 10 bp, Saccharomyces cerevisiae
ccacaatcct

SEQ ID NO: 7577 - DNA, 10 bp, Saccharomyces cerevisiae
ccaccaattt

SEQ ID NO: 7578 - DNA, 10 bp, Saccharomyces cerevisiae
ccaccagatt

SEQ ID NO: 7579 - DNA, 10 bp, Saccharomyces cerevisiae
ccacggccac

SEQ ID NO: 7580 - DNA, 10 bp, Saccharomyces cerevisiae
ccacggtttt

SEQ ID NO: 7581 - DNA, 10 bp, Saccharomyces cerevisiae
ccactaaaag

SEQ ID NO: 7582 - DNA, 10 bp, Saccharomyces cerevisiae
ccactaaaat

SEQ ID NO: 7583 - DNA, 10 bp, Saccharomyces cerevisiae
ccactcacgg

SEQ ID NO: 7584 - DNA, 10 bp, Saccharomyces cerevisiae
ccactgacct

SEQ ID NO: 7585 - DNA, 10 bp, Saccharomyces cerevisiae
ccagaaaact

SEQ ID NO: 7586 - DNA, 10 bp, Saccharomyces cerevisiae
ccagaaacaa

SEQ ID NO: 7587 - DNA, 10 bp, Saccharomyces cerevisiae
ccagaaatga

SEQ ID NO: 7588 - DNA, 10 bp, Saccharomyces cerevisiae
ccagaacaaa

SEQ ID NO: 7589 - DNA, 10 bp, Saccharomyces cerevisiae
ccagaactat

SEQ ID NO: 7590 - DNA, 10 bp, Saccharomyces cerevisiae
ccagaagcta

SEQ ID NO: 7591 - DNA, 10 bp, Saccharomyces cerevisiae
ccagaatatc

SEQ ID NO: 7592 - DNA, 10 bp, Saccharomyces cerevisiae
ccagaattgt

SEQ ID NO: 7593 - DNA, 10 bp, Saccharomyces cerevisiae
ccagaggcaa

SEQ ID NO: 7594 - DNA, 10 bp, Saccharomyces cerevisiae
ccagagttca

SEQ ID NO: 7595 - DNA, 10 bp, Saccharomyces cerevisiae
ccagatatgg

SEQ ID NO: 7596 - DNA, 10 bp, Saccharomyces cerevisiae
ccagatctgt

SEQ ID NO: 7597 - DNA, 10 bp, Saccharomyces cerevisiae
ccagattagt

SEQ ID NO: 7598 - DNA, 10 bp, Saccharomyces cerevisiae
ccagattatg

SEQ ID NO: 7599 - DNA, 10 bp, Saccharomyces cerevisiae
ccagattcgt

SEQ ID NO: 7600 - DNA, 10 bp, Saccharomyces cerevisiae
ccagatttat

SEQ ID NO: 7601 - DNA, 10 bp, Saccharomyces cerevisiae
ccagatttga

SEQ ID NO: 7602 - DNA, 10 bp, Saccharomyces cerevisiae
ccagatttgg

SEQ ID NO: 7603 - DNA, 10 bp, Saccharomyces cerevisiae
ccagcaagat

SEQ ID NO: 7604 - DNA, 10 bp, Saccharomyces cerevisiae
ccagcaggcg

SEQ ID NO: 7605 - DNA, 10 bp, Saccharomyces cerevisiae
ccagcgagcg

SEQ ID NO: 7606 - DNA, 10 bp, Saccharomyces cerevisiae
ccagctgatg

SEQ ID NO: 7607 - DNA, 10 bp, Saccharomyces cerevisiae
ccagctttgg

SEQ ID NO: 7608 - DNA, 10 bp, Saccharomyces cerevisiae
ccaggcatcc

SEQ ID NO: 7609 - DNA, 10 bp, Saccharomyces cerevisiae
ccagggacca

SEQ ID NO: 7610 - DNA, 10 bp, Saccharomyces cerevisiae
ccaggggaga

SEQ ID NO: 7611 - DNA, 10 bp, Saccharomyces cerevisiae
ccaggtatga

SEQ ID NO: 7612 - DNA, 10 bp, Saccharomyces cerevisiae
ccaggtctga

SEQ ID NO: 7613 - DNA, 10 bp, Saccharomyces cerevisiae
ccaggtgaat

SEQ ID NO: 7614 - DNA, 10 bp, Saccharomyces cerevisiae
ccagtaagag

SEQ ID NO: 7615 - DNA, 10 bp, Saccharomyces cerevisiae
ccagtatgac

SEQ ID NO: 7616 - DNA, 10 bp, Saccharomyces cerevisiae
ccagtgaata

SEQ ID NO: 7617 - DNA, 10 bp, Saccharomyces cerevisiae
ccagtttgag

SEQ ID NO: 7618 - DNA, 10 bp, Saccharomyces cerevisiae
ccataaagtt

SEQ ID NO: 7619 - DNA, 10 bp, Saccharomyces cerevisiae
ccatacaata

SEQ ID NO: 7620 - DNA, 10 bp, Saccharomyces cerevisiae
ccatacaggc

SEQ ID NO: 7621 - DNA, 10 bp, Saccharomyces cerevisiae
ccatactacg

SEQ ID NO: 7622 - DNA, 10 bp, Saccharomyces cerevisiae
ccatagctta

SEQ ID NO: 7623 - DNA, 10 bp, Saccharomyces cerevisiae
ccatatttct

SEQ ID NO: 7624 - DNA, 10 bp, Saccharomyces cerevisiae
ccatcaagcc

SEQ ID NO: 7625 - DNA, 10 bp, Saccharomyces cerevisiae
ccatcacatc

SEQ ID NO: 7626 - DNA, 10 bp, Saccharomyces cerevisiae
ccatcagttt

SEQ ID NO: 7627 - DNA, 10 bp, Saccharomyces cerevisiae
ccatccctac

SEQ ID NO: 7628 - DNA, 10 bp, Saccharomyces cerevisiae
ccatcctggg

SEQ ID NO: 7629 - DNA, 10 bp, Saccharomyces cerevisiae
ccatcggtac

SEQ ID NO: 7630 - DNA, 10 bp, Saccharomyces cerevisiae
ccatctcaaa

SEQ ID NO: 7631 - DNA, 10 bp, Saccharomyces cerevisiae
ccatcttaac

SEQ ID NO: 7632 - DNA, 10 bp, Saccharomyces cerevisiae
ccatctttag

SEQ ID NO: 7633 - DNA, 10 bp, Saccharomyces cerevisiae
ccatctttct

SEQ ID NO: 7634 - DNA, 10 bp, Saccharomyces cerevisiae
ccatctttga

SEQ ID NO: 7635 - DNA, 10 bp, Saccharomyces cerevisiae
ccatctttgc

SEQ ID NO: 7636 - DNA, 10 bp, Saccharomyces cerevisiae
ccattacatt

SEQ ID NO: 7637 - DNA, 10 bp, Saccharomyces cerevisiae
ccattagaac

SEQ ID NO: 7638 - DNA, 10 bp, Saccharomyces cerevisiae
ccattatcaa

SEQ ID NO: 7639 - DNA, 10 bp, Saccharomyces cerevisiae
ccattctgga

SEQ ID NO: 7640 - DNA, 10 bp, Saccharomyces cerevisiae
ccattctggt

SEQ ID NO: 7641 - DNA, 10 bp, Saccharomyces cerevisiae
ccattgaaca

SEQ ID NO: 7642 - DNA, 10 bp, Saccharomyces cerevisiae
ccattgctgt

SEQ ID NO: 7643 - DNA, 10 bp, Saccharomyces cerevisiae
ccatttggaa

SEQ ID NO: 7644 - DNA, 10 bp, Saccharomyces cerevisiae
ccatttggac

SEQ ID NO: 7645 - DNA, 10 bp, Saccharomyces cerevisiae
ccatttttca

SEQ ID NO: 7646 - DNA, 10 bp, Saccharomyces cerevisiae
ccatttttct

SEQ ID NO: 7647 - DNA, 10 bp, Saccharomyces cerevisiae
cccaaaaaaa

SEQ ID NO: 7648 - DNA, 10 bp, Saccharomyces cerevisiae
cccaaaactc

SEQ ID NO: 7649 - DNA, 10 bp, Saccharomyces cerevisiae
cccaaaatgg

SEQ ID NO: 7650 - DNA, 10 bp, Saccharomyces cerevisiae
cccaaagctg

SEQ ID NO: 7651 - DNA, 10 bp, Saccharomyces cerevisiae
cccaactact

SEQ ID NO: 7652 - DNA, 10 bp, Saccharomyces cerevisiae
cccaactcgg

SEQ ID NO: 7653 - DNA, 10 bp, Saccharomyces cerevisiae
cccaactttc

SEQ ID NO: 7654 - DNA, 10 bp, Saccharomyces cerevisiae
cccaatccaa

SEQ ID NO: 7655 - DNA, 10 bp, Saccharomyces cerevisiae
cccaattact

SEQ ID NO: 7656 - DNA, 10 bp, Saccharomyces cerevisiae
cccaccaaga

SEQ ID NO: 7657 - DNA, 10 bp, Saccharomyces cerevisiae
cccaccatca

SEQ ID NO: 7658 - DNA, 10 bp, Saccharomyces cerevisiae
cccaccttat

SEQ ID NO: 7659 - DNA, 10 bp, Saccharomyces cerevisiae
cccacggaag

SEQ ID NO: 7660 - DNA, 10 bp, Saccharomyces cerevisiae
cccacggttc

SEQ ID NO: 7661 - DNA, 10 bp, Saccharomyces cerevisiae
cccactcacg

SEQ ID NO: 7662 - DNA, 10 bp, Saccharomyces cerevisiae
cccagatatg

SEQ ID NO: 7663 - DNA, 10 bp, Saccharomyces cerevisiae
cccagggtat

SEQ ID NO: 7664 - DNA, 10 bp, Saccharomyces cerevisiae
cccagtaccg

SEQ ID NO: 7665 - DNA, 10 bp, Saccharomyces cerevisiae
cccatactca

SEQ ID NO: 7666 - DNA, 10 bp, Saccharomyces cerevisiae
cccatcttta

SEQ ID NO: 7667 - DNA, 10 bp, Saccharomyces cerevisiae
cccattgaaa

SEQ ID NO: 7668 - DNA, 10 bp, Saccharomyces cerevisiae
cccattttct

SEQ ID NO: 7669 - DNA, 10 bp, Saccharomyces cerevisiae
cccccgtaac

SEQ ID NO: 7670 - DNA, 10 bp, Saccharomyces cerevisiae
cccccgtaca

SEQ ID NO: 7671 - DNA, 10 bp, Saccharomyces cerevisiae
ccccgattgg

SEQ ID NO: 7672 - DNA, 10 bp, Saccharomyces cerevisiae
ccccgctgga

SEQ ID NO: 7673 - DNA, 10 bp, Saccharomyces cerevisiae
ccccgtacaa

SEQ ID NO: 7674 - DNA, 10 bp, Saccharomyces cerevisiae
ccccgtacac

SEQ ID NO: 7675 - DNA, 10 bp, Saccharomyces cerevisiae
ccccgtccat

SEQ ID NO: 7676 - DNA, 10 bp, Saccharomyces cerevisiae
cccctcaaaa

SEQ ID NO: 7677 - DNA, 10 bp, Saccharomyces cerevisiae
ccccttaatt

SEQ ID NO: 7678 - DNA, 10 bp, Saccharomyces cerevisiae
ccccttgtcg

SEQ ID NO: 7679 - DNA, 10 bp, Saccharomyces cerevisiae
cccgatgttg

SEQ ID NO: 7680 - DNA, 10 bp, Saccharomyces cerevisiae
cccgccataa

SEQ ID NO: 7681 - DNA, 10 bp, Saccharomyces cerevisiae
cccgccgctc

SEQ ID NO: 7682 - DNA, 10 bp, Saccharomyces cerevisiae
cccgcgtctc

SEQ ID NO: 7683 - DNA, 10 bp, Saccharomyces cerevisiae
cccggatatg

SEQ ID NO: 7684 - DNA, 10 bp, Saccharomyces cerevisiae
cccggttttc

SEQ ID NO: 7685 - DNA, 10 bp, Saccharomyces cerevisiae
cccgtaatag

SEQ ID NO: 7686 - DNA, 10 bp, Saccharomyces cerevisiae
ccctaaaaaa

SEQ ID NO: 7687 - DNA, 10 bp, Saccharomyces cerevisiae
ccctaaaatt

SEQ ID NO: 7688 - DNA, 10 bp, Saccharomyces cerevisiae
ccctaaagtt

SEQ ID NO: 7689 - DNA, 10 bp, Saccharomyces cerevisiae
ccctactacg

SEQ ID NO: 7690 - DNA, 10 bp, Saccharomyces cerevisiae
ccctactgtc

SEQ ID NO: 7691 - DNA, 10 bp, Saccharomyces cerevisiae
ccctagaaag

SEQ ID NO: 7692 - DNA, 10 bp, Saccharomyces cerevisiae
ccctccctcc

SEQ ID NO: 7693 - DNA, 10 bp, Saccharomyces cerevisiae
ccctcctata

SEQ ID NO: 7694 - DNA, 10 bp, Saccharomyces cerevisiae
ccctgcaaac

SEQ ID NO: 7695 - DNA, 10 bp, Saccharomyces cerevisiae
ccctggaagt

SEQ ID NO: 7696 - DNA, 10 bp, Saccharomyces cerevisiae
cccttcccct

SEQ ID NO: 7697 - DNA, 10 bp, Saccharomyces cerevisiae
cccttctgtg

SEQ ID NO: 7698 - DNA, 10 bp, Saccharomyces cerevisiae
cccttgaaaa

SEQ ID NO: 7699 - DNA, 10 bp, Saccharomyces cerevisiae
ccgaacctgt

SEQ ID NO: 7700 - DNA, 10 bp, Saccharomyces cerevisiae
ccgaacgggt

SEQ ID NO: 7701 - DNA, 10 bp, Saccharomyces cerevisiae
ccgacaacgt

SEQ ID NO: 7702 - DNA, 10 bp, Saccharomyces cerevisiae
ccgacaagtc

SEQ ID NO: 7703 - DNA, 10 bp, Saccharomyces cerevisiae
ccgagaagaa

SEQ ID NO: 7704 - DNA, 10 bp, Saccharomyces cerevisiae
ccgagaagtt

SEQ ID NO: 7705 - DNA, 10 bp, Saccharomyces cerevisiae
ccgagggtat

SEQ ID NO: 7706 - DNA, 10 bp, Saccharomyces cerevisiae
ccgataaaag

SEQ ID NO: 7707 - DNA, 10 bp, Saccharomyces cerevisiae
ccgatatact

SEQ ID NO: 7708 - DNA, 10 bp, Saccharomyces cerevisiae
ccgatcacaa

SEQ ID NO: 7709 - DNA, 10 bp, Saccharomyces cerevisiae
ccgattgttt

SEQ ID NO: 7710 - DNA, 10 bp, Saccharomyces cerevisiae
ccgccagcgc

SEQ ID NO: 7711 - DNA, 10 bp, Saccharomyces cerevisiae
ccgccgctaa

SEQ ID NO: 7712 - DNA, 10 bp, Saccharomyces cerevisiae
ccgccgctat

SEQ ID NO: 7713 - DNA, 10 bp, Saccharomyces cerevisiae
ccgctaaagt

SEQ ID NO: 7714 - DNA, 10 bp, Saccharomyces cerevisiae
ccgctccgaa

SEQ ID NO: 7715 - DNA, 10 bp, Saccharomyces cerevisiae
ccgctgagtc

SEQ ID NO: 7716 - DNA, 10 bp, Saccharomyces cerevisiae
ccggaaagcc

SEQ ID NO: 7717 - DNA, 10 bp, Saccharomyces cerevisiae
ccggaactgc

SEQ ID NO: 7718 - DNA, 10 bp, Saccharomyces cerevisiae
ccggaatgac

SEQ ID NO: 7719 - DNA, 10 bp, Saccharomyces cerevisiae
ccggacaatg

SEQ ID NO: 7720 - DNA, 10 bp, Saccharomyces cerevisiae
ccggacgctg

SEQ ID NO: 7721 - DNA, 10 bp, Saccharomyces cerevisiae
ccggacggca

SEQ ID NO: 7722 - DNA, 10 bp, Saccharomyces cerevisiae
ccggacggtt

SEQ ID NO: 7723 - DNA, 10 bp, Saccharomyces cerevisiae
ccggatatga

SEQ ID NO: 7724 - DNA, 10 bp, Saccharomyces cerevisiae
ccggatcgtc

SEQ ID NO: 7725 - DNA, 10 bp, Saccharomyces cerevisiae
ccggatttgt

SEQ ID NO: 7726 - DNA, 10 bp, Saccharomyces cerevisiae
ccggcaaacc

SEQ ID NO: 7727 - DNA, 10 bp, Saccharomyces cerevisiae
ccgggattga

SEQ ID NO: 7728 - DNA, 10 bp, Saccharomyces cerevisiae
ccgggcactc

SEQ ID NO: 7729 - DNA, 10 bp, Saccharomyces cerevisiae
ccgggtatcg

SEQ ID NO: 7730 - DNA, 10 bp, Saccharomyces cerevisiae
ccgggtctca

SEQ ID NO: 7731 - DNA, 10 bp, Saccharomyces cerevisiae
ccgggttggt

SEQ ID NO: 7732 - DNA, 10 bp, Saccharomyces cerevisiae
ccggttataa

SEQ ID NO: 7733 - DNA, 10 bp, Saccharomyces cerevisiae
ccggttccga

SEQ ID NO: 7734 - DNA, 10 bp, Saccharomyces cerevisiae
ccggttgcag

SEQ ID NO: 7735 - DNA, 10 bp, Saccharomyces cerevisiae
ccggtttagc

SEQ ID NO: 7736 - DNA, 10 bp, Saccharomyces cerevisiae
ccgtaagtgg

SEQ ID NO: 7737 - DNA, 10 bp, Saccharomyces cerevisiae
ccgtacctct

SEQ ID NO: 7738 - DNA, 10 bp, Saccharomyces cerevisiae
ccgtcactac

SEQ ID NO: 7739 - DNA, 10 bp, Saccharomyces cerevisiae
ccgtccatca

SEQ ID NO: 7740 - DNA, 10 bp, Saccharomyces cerevisiae
ccgtccgtat

SEQ ID NO: 7741 - DNA, 10 bp, Saccharomyces cerevisiae
ccgtcctctt

SEQ ID NO: 7742 - DNA, 10 bp, Saccharomyces cerevisiae
ccgtctgttt

SEQ ID NO: 7743 - DNA, 10 bp, Saccharomyces cerevisiae
ccgtgtatgg

SEQ ID NO: 7744 - DNA, 10 bp, Saccharomyces cerevisiae
ccgttacccc

SEQ ID NO: 7745 - DNA, 10 bp, Saccharomyces cerevisiae
ccgttcaact

SEQ ID NO: 7746 - DNA, 10 bp, Saccharomyces cerevisiae
ccgttgagga

SEQ ID NO: 7747 - DNA, 10 bp, Saccharomyces cerevisiae
ccgttggcag

SEQ ID NO: 7748 - DNA, 10 bp, Saccharomyces cerevisiae
ccgtttttga

SEQ ID NO: 7749 - DNA, 10 bp, Saccharomyces cerevisiae
ccgtttttgg

SEQ ID NO: 7750 - DNA, 10 bp, Saccharomyces cerevisiae
cctaaagtta

SEQ ID NO: 7751 - DNA, 10 bp, Saccharomyces cerevisiae
cctaagctaa

SEQ ID NO: 7752 - DNA, 10 bp, Saccharomyces cerevisiae
cctaagctga

SEQ ID NO: 7753 - DNA, 10 bp, Saccharomyces cerevisiae
cctaccgtct

SEQ ID NO: 7754 - DNA, 10 bp, Saccharomyces cerevisiae
cctactaaaa

SEQ ID NO: 7755 - DNA, 10 bp, Saccharomyces cerevisiae
cctatagaaa

SEQ ID NO: 7756 - DNA, 10 bp, Saccharomyces cerevisiae
cctatagggc

SEQ ID NO: 7757 - DNA, 10 bp, Saccharomyces cerevisiae
cctatctata

SEQ ID NO: 7758 - DNA, 10 bp, Saccharomyces cerevisiae
cctattgtta

SEQ ID NO: 7759 - DNA, 10 bp, Saccharomyces cerevisiae
cctcaactta

SEQ ID NO: 7760 - DNA, 10 bp, Saccharomyces cerevisiae
cctcaaggtt

SEQ ID NO: 7761 - DNA, 10 bp, Saccharomyces cerevisiae
cctcagaaag

SEQ ID NO: 7762 - DNA, 10 bp, Saccharomyces cerevisiae
cctccaataa

SEQ ID NO: 7763 - DNA, 10 bp, Saccharomyces cerevisiae
cctccagcac

SEQ ID NO: 7764 - DNA, 10 bp, Saccharomyces cerevisiae
cctccattga

SEQ ID NO: 7765 - DNA, 10 bp, Saccharomyces cerevisiae
cctcctaatg

SEQ ID NO: 7766 - DNA, 10 bp, Saccharomyces cerevisiae
cctcctggtg

SEQ ID NO: 7767 - DNA, 10 bp, Saccharomyces cerevisiae
cctctatagc

SEQ ID NO: 7768 - DNA, 10 bp, Saccharomyces cerevisiae
cctctcttga

SEQ ID NO: 7769 - DNA, 10 bp, Saccharomyces cerevisiae
cctctctttt

SEQ ID NO: 7770 - DNA, 10 bp, Saccharomyces cerevisiae
cctctgaaag

SEQ ID NO: 7771 - DNA, 10 bp, Saccharomyces cerevisiae
cctctgggaa

SEQ ID NO: 7772 - DNA, 10 bp, Saccharomyces cerevisiae
cctctgggta

SEQ ID NO: 7773 - DNA, 10 bp, Saccharomyces cerevisiae
cctcttaaca

SEQ ID NO: 7774 - DNA, 10 bp, Saccharomyces cerevisiae
cctgaagttt

SEQ ID NO: 7775 - DNA, 10 bp, Saccharomyces cerevisiae
cctgaataaa

SEQ ID NO: 7776 - DNA, 10 bp, Saccharomyces cerevisiae
cctgaatctc

SEQ ID NO: 7777 - DNA, 10 bp, Saccharomyces cerevisiae
cctgacgtgt

SEQ ID NO: 7778 - DNA, 10 bp, Saccharomyces cerevisiae
cctgaggtat

SEQ ID NO: 7779 - DNA, 10 bp, Saccharomyces cerevisiae
cctgagtatg

SEQ ID NO: 7780 - DNA, 10 bp, Saccharomyces cerevisiae
cctgatcaag

SEQ ID NO: 7781 - DNA, 10 bp, Saccharomyces cerevisiae
cctgatgagg

SEQ ID NO: 7782 - DNA, 10 bp, Saccharomyces cerevisiae
cctgatttgt

SEQ ID NO: 7783 - DNA, 10 bp, Saccharomyces cerevisiae
cctgcaaaaa

SEQ ID NO: 7784 - DNA, 10 bp, Saccharomyces cerevisiae
cctgcaaacc

SEQ ID NO: 7785 - DNA, 10 bp, Saccharomyces cerevisiae
cctgcaagcg

SEQ ID NO: 7786 - DNA, 10 bp, Saccharomyces cerevisiae
cctgctcaaa

SEQ ID NO: 7787 - DNA, 10 bp, Saccharomyces cerevisiae
cctggaagta

SEQ ID NO: 7788 - DNA, 10 bp, Saccharomyces cerevisiae
cctggagcag

SEQ ID NO: 7789 - DNA, 10 bp, Saccharomyces cerevisiae
cctggcgctc

SEQ ID NO: 7790 - DNA, 10 bp, Saccharomyces cerevisiae
cctgggtcgt

SEQ ID NO: 7791 - DNA, 10 bp, Saccharomyces cerevisiae
cctggtaatc

SEQ ID NO: 7792 - DNA, 10 bp, Saccharomyces cerevisiae
cctggtgtta

SEQ ID NO: 7793 - DNA, 10 bp, Saccharomyces cerevisiae
cctgtcgctg

SEQ ID NO: 7794 - DNA, 10 bp, Saccharomyces cerevisiae
cctgtgacca

SEQ ID NO: 7795 - DNA, 10 bp, Saccharomyces cerevisiae
cctgtgcttt

SEQ ID NO: 7796 - DNA, 10 bp, Saccharomyces cerevisiae
cctgttctca

SEQ ID NO: 7797 - DNA, 10 bp, Saccharomyces cerevisiae
ccttaaaaaa

SEQ ID NO: 7798 - DNA, 10 bp, Saccharomyces cerevisiae
ccttacaatc

SEQ ID NO: 7799 - DNA, 10 bp, Saccharomyces cerevisiae
ccttatgttg

SEQ ID NO: 7800 - DNA, 10 bp, Saccharomyces cerevisiae
ccttcaacaa

SEQ ID NO: 7801 - DNA, 10 bp, Saccharomyces cerevisiae
ccttcacttt

SEQ ID NO: 7802 - DNA, 10 bp, Saccharomyces cerevisiae
ccttccaggg

SEQ ID NO: 7803 - DNA, 10 bp, Saccharomyces cerevisiae
ccttccgaat

SEQ ID NO: 7804 - DNA, 10 bp, Saccharomyces cerevisiae
ccttcctaaa

SEQ ID NO: 7805 - DNA, 10 bp, Saccharomyces cerevisiae
ccttcctatg

SEQ ID NO: 7806 - DNA, 10 bp, Saccharomyces cerevisiae
ccttctcgtt

SEQ ID NO: 7807 - DNA, 10 bp, Saccharomyces cerevisiae
ccttctgctg

SEQ ID NO: 7808 - DNA, 10 bp, Saccharomyces cerevisiae
ccttctgttt

SEQ ID NO: 7809 - DNA, 10 bp, Saccharomyces cerevisiae
ccttcttaca

SEQ ID NO: 7810 - DNA, 10 bp, Saccharomyces cerevisiae
ccttgcaagc

SEQ ID NO: 7811 - DNA, 10 bp, Saccharomyces cerevisiae
ccttggcatt

SEQ ID NO: 7812 - DNA, 10 bp, Saccharomyces cerevisiae
cctttagccc

SEQ ID NO: 7813 - DNA, 10 bp, Saccharomyces cerevisiae
cctttcagtt

SEQ ID NO: 7814 - DNA, 10 bp, Saccharomyces cerevisiae
cctttgagga

SEQ ID NO: 7815 - DNA, 10 bp, Saccharomyces cerevisiae
cctttgagtg

SEQ ID NO: 7816 - DNA, 10 bp, Saccharomyces cerevisiae
cctttgatat

SEQ ID NO: 7817 - DNA, 10 bp, Saccharomyces cerevisiae
cctttgctaa

SEQ ID NO: 7818 - DNA, 10 bp, Saccharomyces cerevisiae
cctttggacc

SEQ ID NO: 7819 - DNA, 10 bp, Saccharomyces cerevisiae
cctttggaga

SEQ ID NO: 7820 - DNA, 10 bp, Saccharomyces cerevisiae
ccttttacgt

SEQ ID NO: 7821 - DNA, 10 bp, Saccharomyces cerevisiae
ccttttattt

SEQ ID NO: 7822 - DNA, 10 bp, Saccharomyces cerevisiae
ccttttcgta

SEQ ID NO: 7823 - DNA, 10 bp, Saccharomyces cerevisiae
cctttttaca

SEQ ID NO: 7824 - DNA, 10 bp, Saccharomyces cerevisiae
ccttttttga

SEQ ID NO: 7825 - DNA, 10 bp, Saccharomyces cerevisiae
cgaaaaaaaa

SEQ ID NO: 7826 - DNA, 10 bp, Saccharomyces cerevisiae
cgaaagactg

SEQ ID NO: 7827 - DNA, 10 bp, Saccharomyces cerevisiae
cgaaatttta

SEQ ID NO: 7828 - DNA, 10 bp, Saccharomyces cerevisiae
cgaacgagaa

SEQ ID NO: 7829 - DNA, 10 bp, Saccharomyces cerevisiae
cgaacttttc

SEQ ID NO: 7830 - DNA, 10 bp, Saccharomyces cerevisiae
cgaagatctt

SEQ ID NO: 7831 - DNA, 10 bp, Saccharomyces cerevisiae
cgaagatggc

SEQ ID NO: 7832 - DNA, 10 bp, Saccharomyces cerevisiae
cgaagttcgc

SEQ ID NO: 7833 - DNA, 10 bp, Saccharomyces cerevisiae
cgaataatcc

SEQ ID NO: 7834 - DNA, 10 bp, Saccharomyces cerevisiae
cgaatattct

SEQ ID NO: 7835 - DNA, 10 bp, Saccharomyces cerevisiae
cgaatccgtc

SEQ ID NO: 7836 - DNA, 10 bp, Saccharomyces cerevisiae
cgaatcgaga

SEQ ID NO: 7837 - DNA, 10 bp, Saccharomyces cerevisiae
cgaatctccc

SEQ ID NO: 7838 - DNA, 10 bp, Saccharomyces cerevisiae
cgaattgcgt

SEQ ID NO: 7839 - DNA, 10 bp, Saccharomyces cerevisiae
cgaatttttg

SEQ ID NO: 7840 - DNA, 10 bp, Saccharomyces cerevisiae
cgacaaactg

SEQ ID NO: 7841 - DNA, 10 bp, Saccharomyces cerevisiae
cgacagcggt

SEQ ID NO: 7842 - DNA, 10 bp, Saccharomyces cerevisiae
cgacagtgac

SEQ ID NO: 7843 - DNA, 10 bp, Saccharomyces cerevisiae
cgaccttagt

SEQ ID NO: 7844 - DNA, 10 bp, Saccharomyces cerevisiae
cgaccttgtt

SEQ ID NO: 7845 - DNA, 10 bp, Saccharomyces cerevisiae
cgacggagtt

SEQ ID NO: 7846 - DNA, 10 bp, Saccharomyces cerevisiae
cgacgtattt

SEQ ID NO: 7847 - DNA, 10 bp, Saccharomyces cerevisiae
cgactgggtt

SEQ ID NO: 7848 - DNA, 10 bp, Saccharomyces cerevisiae
cgagagaaga

SEQ ID NO: 7849 - DNA, 10 bp, Saccharomyces cerevisiae
cgagatcaca

SEQ ID NO: 7850 - DNA, 10 bp, Saccharomyces cerevisiae
cgagatttaa

SEQ ID NO: 7851 - DNA, 10 bp, Saccharomyces cerevisiae
cgagcaatag

SEQ ID NO: 7852 - DNA, 10 bp, Saccharomyces cerevisiae
cgagctttca

SEQ ID NO: 7853 - DNA, 10 bp, Saccharomyces cerevisiae
cgaggcgaga

SEQ ID NO: 7854 - DNA, 10 bp, Saccharomyces cerevisiae
cgaggctccg

SEQ ID NO: 7855 - DNA, 10 bp, Saccharomyces cerevisiae
cgagggaagc

SEQ ID NO: 7856 - DNA, 10 bp, Saccharomyces cerevisiae
cgagtccttc

SEQ ID NO: 7857 - DNA, 10 bp, Saccharomyces cerevisiae
cgagtgcata

SEQ ID NO: 7858 - DNA, 10 bp, Saccharomyces cerevisiae
cgatccttca

SEQ ID NO: 7859 - DNA, 10 bp, Saccharomyces cerevisiae
cgatcttgga

SEQ ID NO: 7860 - DNA, 10 bp, Saccharomyces cerevisiae
cgatctttac

SEQ ID NO: 7861 - DNA, 10 bp, Saccharomyces cerevisiae
cgatgacaga

SEQ ID NO: 7862 - DNA, 10 bp, Saccharomyces cerevisiae
cgatgctcct

SEQ ID NO: 7863 - DNA, 10 bp, Saccharomyces cerevisiae
cgatggttcc

SEQ ID NO: 7864 - DNA, 10 bp, Saccharomyces cerevisiae
cgatgtgtaa

SEQ ID NO: 7865 - DNA, 10 bp, Saccharomyces cerevisiae
cgattaatca

SEQ ID NO: 7866 - DNA, 10 bp, Saccharomyces cerevisiae
cgattacagt

SEQ ID NO: 7867 - DNA, 10 bp, Saccharomyces cerevisiae
cgattcattt

SEQ ID NO: 7868 - DNA, 10 bp, Saccharomyces cerevisiae
cgattgcaca

SEQ ID NO: 7869 - DNA, 10 bp, Saccharomyces cerevisiae
cgattgcgca

SEQ ID NO: 7870 - DNA, 10 bp, Saccharomyces cerevisiae
cgattttaac

SEQ ID NO: 7871 - DNA, 10 bp, Saccharomyces cerevisiae
cgatttttga

SEQ ID NO: 7872 - DNA, 10 bp, Saccharomyces cerevisiae
cgcaaaaatc

SEQ ID NO: 7873 - DNA, 10 bp, Saccharomyces cerevisiae
cgcaaaagct

SEQ ID NO: 7874 - DNA, 10 bp, Saccharomyces cerevisiae
cgcaacgtgt

SEQ ID NO: 7875 - DNA, 10 bp, Saccharomyces cerevisiae
cgcaagaatt

SEQ ID NO: 7876 - DNA, 10 bp, Saccharomyces cerevisiae
cgcaatatca

SEQ ID NO: 7877 - DNA, 10 bp, Saccharomyces cerevisiae
cgcacgagtg

SEQ ID NO: 7878 - DNA, 10 bp, Saccharomyces cerevisiae
cgcagaggcc

SEQ ID NO: 7879 - DNA, 10 bp, Saccharomyces cerevisiae
cgcagcggta

SEQ ID NO: 7880 - DNA, 10 bp, Saccharomyces cerevisiae
cgcagttatt

SEQ ID NO: 7881 - DNA, 10 bp, Saccharomyces cerevisiae
cgcataaaaa

SEQ ID NO: 7882 - DNA, 10 bp, Saccharomyces cerevisiae
cgcatctctt

SEQ ID NO: 7883 - DNA, 10 bp, Saccharomyces cerevisiae
cgcattagta

SEQ ID NO: 7884 - DNA, 10 bp, Saccharomyces cerevisiae
cgcattatat

SEQ ID NO: 7885 - DNA, 10 bp, Saccharomyces cerevisiae
cgcattcggg

SEQ ID NO: 7886 - DNA, 10 bp, Saccharomyces cerevisiae
cgcatttaag

SEQ ID NO: 7887 - DNA, 10 bp, Saccharomyces cerevisiae
cgcatttaca

SEQ ID NO: 7888 - DNA, 10 bp, Saccharomyces cerevisiae
cgcatttgac

SEQ ID NO: 7889 - DNA, 10 bp, Saccharomyces cerevisiae
cgccaaaata

SEQ ID NO: 7890 - DNA, 10 bp, Saccharomyces cerevisiae
cgccaaatct

SEQ ID NO: 7891 - DNA, 10 bp, Saccharomyces cerevisiae
cgccactcaa

SEQ ID NO: 7892 - DNA, 10 bp, Saccharomyces cerevisiae
cgccagaacc

SEQ ID NO: 7893 - DNA, 10 bp, Saccharomyces cerevisiae
cgccattaaa

SEQ ID NO: 7894 - DNA, 10 bp, Saccharomyces cerevisiae
cgcctgaatg

SEQ ID NO: 7895 - DNA, 10 bp, Saccharomyces cerevisiae
cgcgaaaata

SEQ ID NO: 7896 - DNA, 10 bp, Saccharomyces cerevisiae
cgcgcaatag

SEQ ID NO: 7897 - DNA, 10 bp, Saccharomyces cerevisiae
cgcgcgtata

SEQ ID NO: 7898 - DNA, 10 bp, Saccharomyces cerevisiae
cgcgctaagg

SEQ ID NO: 7899 - DNA, 10 bp, Saccharomyces cerevisiae
cgcgtttgta

SEQ ID NO: 7900 - DNA, 10 bp, Saccharomyces cerevisiae
cgctaactac

SEQ ID NO: 7901 - DNA, 10 bp, Saccharomyces cerevisiae
cgctaagtga

SEQ ID NO: 7902 - DNA, 10 bp, Saccharomyces cerevisiae
cgctacatat

SEQ ID NO: 7903 - DNA, 10 bp, Saccharomyces cerevisiae
cgctacgttc

SEQ ID NO: 7904 - DNA, 10 bp, Saccharomyces cerevisiae
cgctactgtc

SEQ ID NO: 7905 - DNA, 10 bp, Saccharomyces cerevisiae
cgctccaacc

SEQ ID NO: 7906 - DNA, 10 bp, Saccharomyces cerevisiae
cgctctttcc

SEQ ID NO: 7907 - DNA, 10 bp, Saccharomyces cerevisiae
cgctgggtaa

SEQ ID NO: 7908 - DNA, 10 bp, Saccharomyces cerevisiae
cgcttgtgat

SEQ ID NO: 7909 - DNA, 10 bp, Saccharomyces cerevisiae
cgcttttgcg

SEQ ID NO: 7910 - DNA, 10 bp, Saccharomyces cerevisiae
cggaaaactt

SEQ ID NO: 7911 - DNA, 10 bp, Saccharomyces cerevisiae
cggaaagatg

SEQ ID NO: 7912 - DNA, 10 bp, Saccharomyces cerevisiae
cggaaggtct

SEQ ID NO: 7913 - DNA, 10 bp, Saccharomyces cerevisiae
cggaatttgt

SEQ ID NO: 7914 - DNA, 10 bp, Saccharomyces cerevisiae
cggacaaatc

SEQ ID NO: 7915 - DNA, 10 bp, Saccharomyces cerevisiae
cggaccattg

SEQ ID NO: 7916 - DNA, 10 bp, Saccharomyces cerevisiae
cggacctggt

SEQ ID NO: 7917 - DNA, 10 bp, Saccharomyces cerevisiae
cggaccttgg

SEQ ID NO: 7918 - DNA, 10 bp, Saccharomyces cerevisiae
cggagaataa

SEQ ID NO: 7919 - DNA, 10 bp, Saccharomyces cerevisiae
cggagggtat

SEQ ID NO: 7920 - DNA, 10 bp, Saccharomyces cerevisiae
cggatggtac

SEQ ID NO: 7921 - DNA, 10 bp, Saccharomyces cerevisiae
cggattacca

SEQ ID NO: 7922 - DNA, 10 bp, Saccharomyces cerevisiae
cggcaaaaaa

SEQ ID NO: 7923 - DNA, 10 bp, Saccharomyces cerevisiae
cggcaaattc

SEQ ID NO: 7924 - DNA, 10 bp, Saccharomyces cerevisiae
cggcccgtag

SEQ ID NO: 7925 - DNA, 10 bp, Saccharomyces cerevisiae
cggctctggg

SEQ ID NO: 7926 - DNA, 10 bp, Saccharomyces cerevisiae
cggcttggga

SEQ ID NO: 7927 - DNA, 10 bp, Saccharomyces cerevisiae
cgggaacaat

SEQ ID NO: 7928 - DNA, 10 bp, Saccharomyces cerevisiae
cgggaataat

SEQ ID NO: 7929 - DNA, 10 bp, Saccharomyces cerevisiae
cgggaatttt

SEQ ID NO: 7930 - DNA, 10 bp, Saccharomyces cerevisiae
cgggacgcca

SEQ ID NO: 7931 - DNA, 10 bp, Saccharomyces cerevisiae
cgggagaact

SEQ ID NO: 7932 - DNA, 10 bp, Saccharomyces cerevisiae
cgggagctaa

SEQ ID NO: 7933 - DNA, 10 bp, Saccharomyces cerevisiae
cgggcgtgaa

SEQ ID NO: 7934 - DNA, 10 bp, Saccharomyces cerevisiae
cgggtcatca

SEQ ID NO: 7935 - DNA, 10 bp, Saccharomyces cerevisiae
cgggttgatg

SEQ ID NO: 7936 - DNA, 10 bp, Saccharomyces cerevisiae
cggtaatata

SEQ ID NO: 7937 - DNA, 10 bp, Saccharomyces cerevisiae
cggtagccca

SEQ ID NO: 7938 - DNA, 10 bp, Saccharomyces cerevisiae
cggtagtccg

SEQ ID NO: 7939 - DNA, 10 bp, Saccharomyces cerevisiae
cggtagtcct

SEQ ID NO: 7940 - DNA, 10 bp, Saccharomyces cerevisiae
cggtagtcga

SEQ ID NO: 7941 - DNA, 10 bp, Saccharomyces cerevisiae
cggtcaccat

SEQ ID NO: 7942 - DNA, 10 bp, Saccharomyces cerevisiae
cggtccaaac

SEQ ID NO: 7943 - DNA, 10 bp, Saccharomyces cerevisiae
cggtcccatt

SEQ ID NO: 7944 - DNA, 10 bp, Saccharomyces cerevisiae
cggtgaaaga

SEQ ID NO: 7945 - DNA, 10 bp, Saccharomyces cerevisiae
cggtgagtga

SEQ ID NO: 7946 - DNA, 10 bp, Saccharomyces cerevisiae
cggtgagtgg

SEQ ID NO: 7947 - DNA, 10 bp, Saccharomyces cerevisiae
cggtggctta

SEQ ID NO: 7948 - DNA, 10 bp, Saccharomyces cerevisiae
cggtggtaga

SEQ ID NO: 7949 - DNA, 10 bp, Saccharomyces cerevisiae
cggttagtat

SEQ ID NO: 7950 - DNA, 10 bp, Saccharomyces cerevisiae
cggtttgagc

SEQ ID NO: 7951 - DNA, 10 bp, Saccharomyces cerevisiae
cggttttcta

SEQ ID NO: 7952 - DNA, 10 bp, Saccharomyces cerevisiae
cggttttggg

SEQ ID NO: 7953 - DNA, 10 bp, Saccharomyces cerevisiae
cgtaaaaaaa

SEQ ID NO: 7954 - DNA, 10 bp, Saccharomyces cerevisiae
cgtaaatacc

SEQ ID NO: 7955 - DNA, 10 bp, Saccharomyces cerevisiae
cgtaagaaaa

SEQ ID NO: 7956 - DNA, 10 bp, Saccharomyces cerevisiae
cgtaatgtcg

SEQ ID NO: 7957 - DNA, 10 bp, Saccharomyces cerevisiae
cgtacacaaa

SEQ ID NO: 7958 - DNA, 10 bp, Saccharomyces cerevisiae
cgtacagaaa

SEQ ID NO: 7959 - DNA, 10 bp, Saccharomyces cerevisiae
cgtagcagta

SEQ ID NO: 7960 - DNA, 10 bp, Saccharomyces cerevisiae
cgtaggatga

SEQ ID NO: 7961 - DNA, 10 bp, Saccharomyces cerevisiae
cgtagtaagt

SEQ ID NO: 7962 - DNA, 10 bp, Saccharomyces cerevisiae
cgtattagag

SEQ ID NO: 7963 - DNA, 10 bp, Saccharomyces cerevisiae
cgtattcata

SEQ ID NO: 7964 - DNA, 10 bp, Saccharomyces cerevisiae
cgtattctga

SEQ ID NO: 7965 - DNA, 10 bp, Saccharomyces cerevisiae
cgtatttaaa

SEQ ID NO: 7966 - DNA, 10 bp, Saccharomyces cerevisiae
cgtcaaaaca

SEQ ID NO: 7967 - DNA, 10 bp, Saccharomyces cerevisiae
cgtcaatatc

SEQ ID NO: 7968 - DNA, 10 bp, Saccharomyces cerevisiae
cgtcagtgtg

SEQ ID NO: 7969 - DNA, 10 bp, Saccharomyces cerevisiae
cgtccaggat

SEQ ID NO: 7970 - DNA, 10 bp, Saccharomyces cerevisiae
cgtccatccg

SEQ ID NO: 7971 - DNA, 10 bp, Saccharomyces cerevisiae
cgtcgacatc

SEQ ID NO: 7972 - DNA, 10 bp, Saccharomyces cerevisiae
cgtcgagctt

SEQ ID NO: 7973 - DNA, 10 bp, Saccharomyces cerevisiae
cgtctttttt

SEQ ID NO: 7974 - DNA, 10 bp, Saccharomyces cerevisiae
cgtgaggtga

SEQ ID NO: 7975 - DNA, 10 bp, Saccharomyces cerevisiae
cgtgccacca

SEQ ID NO: 7976 - DNA, 10 bp, Saccharomyces cerevisiae
cgtgccatag

SEQ ID NO: 7977 - DNA, 10 bp, Saccharomyces cerevisiae
cgtgcctgct

SEQ ID NO: 7978 - DNA, 10 bp, Saccharomyces cerevisiae
cgtgctttct

SEQ ID NO: 7979 - DNA, 10 bp, Saccharomyces cerevisiae
cgtggaatat

SEQ ID NO: 7980 - DNA, 10 bp, Saccharomyces cerevisiae
cgttaaattt

SEQ ID NO: 7981 - DNA, 10 bp, Saccharomyces cerevisiae
cgttactcac

SEQ ID NO: 7982 - DNA, 10 bp, Saccharomyces cerevisiae
cgttacttgg

SEQ ID NO: 7983 - DNA, 10 bp, Saccharomyces cerevisiae
cgttagattc

SEQ ID NO: 7984 - DNA, 10 bp, Saccharomyces cerevisiae
cgttattggc

SEQ ID NO: 7985 - DNA, 10 bp, Saccharomyces cerevisiae
cgttcaactt

SEQ ID NO: 7986 - DNA, 10 bp, Saccharomyces cerevisiae
cgttcactac

SEQ ID NO: 7987 - DNA, 10 bp, Saccharomyces cerevisiae
cgttcttcac

SEQ ID NO: 7988 - DNA, 10 bp, Saccharomyces cerevisiae
cgttgagaaa

SEQ ID NO: 7989 - DNA, 10 bp, Saccharomyces cerevisiae
cgttgtaaga

SEQ ID NO: 7990 - DNA, 10 bp, Saccharomyces cerevisiae
cgttgtgcct

SEQ ID NO: 7991 - DNA, 10 bp, Saccharomyces cerevisiae
cgtttcagtg

SEQ ID NO: 7992 - DNA, 10 bp, Saccharomyces cerevisiae
cgtttccatt

SEQ ID NO: 7993 - DNA, 10 bp, Saccharomyces cerevisiae
cgtttcggtt

SEQ ID NO: 7994 - DNA, 10 bp, Saccharomyces cerevisiae
cgtttcttcg

SEQ ID NO: 7995 - DNA, 10 bp, Saccharomyces cerevisiae
cgttttaaaa

SEQ ID NO: 7996 - DNA, 10 bp, Saccharomyces cerevisiae
cgttttataa

SEQ ID NO: 7997 - DNA, 10 bp, Saccharomyces cerevisiae
cgttttatat

SEQ ID NO: 7998 - DNA, 10 bp, Saccharomyces cerevisiae
cgttttcttt

SEQ ID NO: 7999 - DNA, 10 bp, Saccharomyces cerevisiae
cgtttttttc

SEQ ID NO: 8000 - DNA, 10 bp, Saccharomyces cerevisiae
ctaaaacggg

SEQ ID NO: 8001 - DNA, 10 bp, Saccharomyces cerevisiae
ctaaaagagg

SEQ ID NO: 8002 - DNA, 10 bp, Saccharomyces cerevisiae
ctaaaatgtc

SEQ ID NO: 8003 - DNA, 10 bp, Saccharomyces cerevisiae
ctaaaatttc

SEQ ID NO: 8004 - DNA, 10 bp, Saccharomyces cerevisiae
ctaaaggggc

SEQ ID NO: 8005 - DNA, 10 bp, Saccharomyces cerevisiae
ctaaatcaaa

SEQ ID NO: 8006 - DNA, 10 bp, Saccharomyces cerevisiae
ctaaatttgc

SEQ ID NO: 8007 - DNA, 10 bp, Saccharomyces cerevisiae
ctaagaaacc

SEQ ID NO: 8008 - DNA, 10 bp, Saccharomyces cerevisiae
ctaagaccgc

SEQ ID NO: 8009 - DNA, 10 bp, Saccharomyces cerevisiae
ctaagcctac

SEQ ID NO: 8010 - DNA, 10 bp, Saccharomyces cerevisiae
ctaagcgtta

SEQ ID NO: 8011 - DNA, 10 bp, Saccharomyces cerevisiae
ctaagggtat

SEQ ID NO: 8012 - DNA, 10 bp, Saccharomyces cerevisiae
ctaataatac

SEQ ID NO: 8013 - DNA, 10 bp, Saccharomyces cerevisiae
ctaatattac

SEQ ID NO: 8014 - DNA, 10 bp, Saccharomyces cerevisiae
ctaatcaaaa

SEQ ID NO: 8015 - DNA, 10 bp, Saccharomyces cerevisiae
ctaatcactt

SEQ ID NO: 8016 - DNA, 10 bp, Saccharomyces cerevisiae
ctaatgggga

SEQ ID NO: 8017 - DNA, 10 bp, Saccharomyces cerevisiae
ctaattcaag

SEQ ID NO: 8018 - DNA, 10 bp, Saccharomyces cerevisiae
ctaattgcat

SEQ ID NO: 8019 - DNA, 10 bp, Saccharomyces cerevisiae
ctaattgtcc

SEQ ID NO: 8020 - DNA, 10 bp, Saccharomyces cerevisiae
ctaatttgct

SEQ ID NO: 8021 - DNA, 10 bp, Saccharomyces cerevisiae
ctacaacgcg

SEQ ID NO: 8022 - DNA, 10 bp, Saccharomyces cerevisiae
ctacaatcca

SEQ ID NO: 8023 - DNA, 10 bp, Saccharomyces cerevisiae
ctacatatat

SEQ ID NO: 8024 - DNA, 10 bp, Saccharomyces cerevisiae
ctacatcaaa

SEQ ID NO: 8025 - DNA, 10 bp, Saccharomyces cerevisiae
ctacatcgat

SEQ ID NO: 8026 - DNA, 10 bp, Saccharomyces cerevisiae
ctaccctcgg

SEQ ID NO: 8027 - DNA, 10 bp, Saccharomyces cerevisiae
ctaccgccta

SEQ ID NO: 8028 - DNA, 10 bp, Saccharomyces cerevisiae
ctaccttacg

SEQ ID NO: 8029 - DNA, 10 bp, Saccharomyces cerevisiae
ctactgggca

SEQ ID NO: 8030 - DNA, 10 bp, Saccharomyces cerevisiae
ctacttccac

SEQ ID NO: 8031 - DNA, 10 bp, Saccharomyces cerevisiae
ctagaaaaag

SEQ ID NO: 8032 - DNA, 10 bp, Saccharomyces cerevisiae
ctagaaagag

SEQ ID NO: 8033 - DNA, 10 bp, Saccharomyces cerevisiae
ctagaaaggt

SEQ ID NO: 8034 - DNA, 10 bp, Saccharomyces cerevisiae
ctagaagact

SEQ ID NO: 8035 - DNA, 10 bp, Saccharomyces cerevisiae
ctagaatatt

SEQ ID NO: 8036 - DNA, 10 bp, Saccharomyces cerevisiae
ctagaattac

SEQ ID NO: 8037 - DNA, 10 bp, Saccharomyces cerevisiae
ctagaattat

SEQ ID NO: 8038 - DNA, 10 bp, Saccharomyces cerevisiae
ctagacactc

SEQ ID NO: 8039 - DNA, 10 bp, Saccharomyces cerevisiae
ctagacgcgc

SEQ ID NO: 8040 - DNA, 10 bp, Saccharomyces cerevisiae
ctagagacga

SEQ ID NO: 8041 - DNA, 10 bp, Saccharomyces cerevisiae
ctagatcagc

SEQ ID NO: 8042 - DNA, 10 bp, Saccharomyces cerevisiae
ctagatttgt

SEQ ID NO: 8043 - DNA, 10 bp, Saccharomyces cerevisiae
ctagcaacgc

SEQ ID NO: 8044 - DNA, 10 bp, Saccharomyces cerevisiae
ctagcacagc

SEQ ID NO: 8045 - DNA, 10 bp, Saccharomyces cerevisiae
ctagcagttt

SEQ ID NO: 8046 - DNA, 10 bp, Saccharomyces cerevisiae
ctagccactg

SEQ ID NO: 8047 - DNA, 10 bp, Saccharomyces cerevisiae
ctagccgtat

SEQ ID NO: 8048 - DNA, 10 bp, Saccharomyces cerevisiae
ctagcgatat

SEQ ID NO: 8049 - DNA, 10 bp, Saccharomyces cerevisiae
ctagcgttgt

SEQ ID NO: 8050 - DNA, 10 bp, Saccharomyces cerevisiae
ctaggcgtta

SEQ ID NO: 8051 - DNA, 10 bp, Saccharomyces cerevisiae
ctagtaatag

SEQ ID NO: 8052 - DNA, 10 bp, Saccharomyces cerevisiae
ctagtgacct

SEQ ID NO: 8053 - DNA, 10 bp, Saccharomyces cerevisiae
ctagtgccca

SEQ ID NO: 8054 - DNA, 10 bp, Saccharomyces cerevisiae
ctataaaaat

SEQ ID NO: 8055 - DNA, 10 bp, Saccharomyces cerevisiae
ctataaaagg

SEQ ID NO: 8056 - DNA, 10 bp, Saccharomyces cerevisiae
ctataaagaa

SEQ ID NO: 8057 - DNA, 10 bp, Saccharomyces cerevisiae
ctataaagac

SEQ ID NO: 8058 - DNA, 10 bp, Saccharomyces cerevisiae
ctataaagct

SEQ ID NO: 8059 - DNA, 10 bp, Saccharomyces cerevisiae
ctatacaaca

SEQ ID NO: 8060 - DNA, 10 bp, Saccharomyces cerevisiae
ctatatcact

SEQ ID NO: 8061 - DNA, 10 bp, Saccharomyces cerevisiae
ctatattcac

SEQ ID NO: 8062 - DNA, 10 bp, Saccharomyces cerevisiae
ctatcaaaga

SEQ ID NO: 8063 - DNA, 10 bp, Saccharomyces cerevisiae
ctatcagcag

SEQ ID NO: 8064 - DNA, 10 bp, Saccharomyces cerevisiae
ctatccgcca

SEQ ID NO: 8065 - DNA, 10 bp, Saccharomyces cerevisiae
ctatcgagtt

SEQ ID NO: 8066 - DNA, 10 bp, Saccharomyces cerevisiae
ctatctaatt

SEQ ID NO: 8067 - DNA, 10 bp, Saccharomyces cerevisiae
ctatcttaca

SEQ ID NO: 8068 - DNA, 10 bp, Saccharomyces cerevisiae
ctatctttac

SEQ ID NO: 8069 - DNA, 10 bp, Saccharomyces cerevisiae
ctatggggat

SEQ ID NO: 8070 - DNA, 10 bp, Saccharomyces cerevisiae
ctatgtaact

SEQ ID NO: 8071 - DNA, 10 bp, Saccharomyces cerevisiae
ctattaggac

SEQ ID NO: 8072 - DNA, 10 bp, Saccharomyces cerevisiae
ctattatata

SEQ ID NO: 8073 - DNA, 10 bp, Saccharomyces cerevisiae
ctattatatt

SEQ ID NO: 8074 - DNA, 10 bp, Saccharomyces cerevisiae
ctattcacga

SEQ ID NO: 8075 - DNA, 10 bp, Saccharomyces cerevisiae
ctattccttt

SEQ ID NO: 8076 - DNA, 10 bp, Saccharomyces cerevisiae
ctattcttat

SEQ ID NO: 8077 - DNA, 10 bp, Saccharomyces cerevisiae
ctattgataa

SEQ ID NO: 8078 - DNA, 10 bp, Saccharomyces cerevisiae
ctattgatac

SEQ ID NO: 8079 - DNA, 10 bp, Saccharomyces cerevisiae
ctattgcttg

SEQ ID NO: 8080 - DNA, 10 bp, Saccharomyces cerevisiae
ctatttcaga

SEQ ID NO: 8081 - DNA, 10 bp, Saccharomyces cerevisiae
ctatttttgg

SEQ ID NO: 8082 - DNA, 10 bp, Saccharomyces cerevisiae
ctcaaaaaaa

SEQ ID NO: 8083 - DNA, 10 bp, Saccharomyces cerevisiae
ctcaaacccg

SEQ ID NO: 8084 - DNA, 10 bp, Saccharomyces cerevisiae
ctcaaattaa

SEQ ID NO: 8085 - DNA, 10 bp, Saccharomyces cerevisiae
ctcaagaggt

SEQ ID NO: 8086 - DNA, 10 bp, Saccharomyces cerevisiae
ctcaagatcc

SEQ ID NO: 8087 - DNA, 10 bp, Saccharomyces cerevisiae
ctcaagatgc

SEQ ID NO: 8088 - DNA, 10 bp, Saccharomyces cerevisiae
ctcaatccac

SEQ ID NO: 8089 - DNA, 10 bp, Saccharomyces cerevisiae
ctcaatccta

SEQ ID NO: 8090 - DNA, 10 bp, Saccharomyces cerevisiae
ctcaatctaa

SEQ ID NO: 8091 - DNA, 10 bp, Saccharomyces cerevisiae
ctcaattgca

SEQ ID NO: 8092 - DNA, 10 bp, Saccharomyces cerevisiae
ctcacaaata

SEQ ID NO: 8093 - DNA, 10 bp, Saccharomyces cerevisiae
ctcacacaaa

SEQ ID NO: 8094 - DNA, 10 bp, Saccharomyces cerevisiae
ctcacacctt

SEQ ID NO: 8095 - DNA, 10 bp, Saccharomyces cerevisiae
ctcacattga

SEQ ID NO: 8096 - DNA, 10 bp, Saccharomyces cerevisiae
ctcactcaat

SEQ ID NO: 8097 - DNA, 10 bp, Saccharomyces cerevisiae
ctcagcaaat

SEQ ID NO: 8098 - DNA, 10 bp, Saccharomyces cerevisiae
ctcagccatt

SEQ ID NO: 8099 - DNA, 10 bp, Saccharomyces cerevisiae
ctcagctcgc

SEQ ID NO: 8100 - DNA, 10 bp, Saccharomyces cerevisiae
ctcagtattg

SEQ ID NO: 8101 - DNA, 10 bp, Saccharomyces cerevisiae
ctcataatcg

SEQ ID NO: 8102 - DNA, 10 bp, Saccharomyces cerevisiae
ctcatcagta

SEQ ID NO: 8103 - DNA, 10 bp, Saccharomyces cerevisiae
ctcatccaag

SEQ ID NO: 8104 - DNA, 10 bp, Saccharomyces cerevisiae
ctcattaacg

SEQ ID NO: 8105 - DNA, 10 bp, Saccharomyces cerevisiae
ctcattatct

SEQ ID NO: 8106 - DNA, 10 bp, Saccharomyces cerevisiae
ctcattgata

SEQ ID NO: 8107 - DNA, 10 bp, Saccharomyces cerevisiae
ctcatttctg

SEQ ID NO: 8108 - DNA, 10 bp, Saccharomyces cerevisiae
ctcattttat

SEQ ID NO: 8109 - DNA, 10 bp, Saccharomyces cerevisiae
ctccaagaaa

SEQ ID NO: 8110 - DNA, 10 bp, Saccharomyces cerevisiae
ctccactgat

SEQ ID NO: 8111 - DNA, 10 bp, Saccharomyces cerevisiae
ctccccatcc

SEQ ID NO: 8112 - DNA, 10 bp, Saccharomyces cerevisiae
ctccctcatt

SEQ ID NO: 8113 - DNA, 10 bp, Saccharomyces cerevisiae
ctccgttttt

SEQ ID NO: 8114 - DNA, 10 bp, Saccharomyces cerevisiae
ctcctccatt

SEQ ID NO: 8115 - DNA, 10 bp, Saccharomyces cerevisiae
ctcctgttta

SEQ ID NO: 8116 - DNA, 10 bp, Saccharomyces cerevisiae
ctccttctat

SEQ ID NO: 8117 - DNA, 10 bp, Saccharomyces cerevisiae
ctcgaaaaag

SEQ ID NO: 8118 - DNA, 10 bp, Saccharomyces cerevisiae
ctcgaacaac

SEQ ID NO: 8119 - DNA, 10 bp, Saccharomyces cerevisiae
ctcgataatc

SEQ ID NO: 8120 - DNA, 10 bp, Saccharomyces cerevisiae
ctcgatagaa

SEQ ID NO: 8121 - DNA, 10 bp, Saccharomyces cerevisiae
ctcgatggag

SEQ ID NO: 8122 - DNA, 10 bp, Saccharomyces cerevisiae
ctcgatgtcg

SEQ ID NO: 8123 - DNA, 10 bp, Saccharomyces cerevisiae
ctcgattctt

SEQ ID NO: 8124 - DNA, 10 bp, Saccharomyces cerevisiae
ctcgcaagat

SEQ ID NO: 8125 - DNA, 10 bp, Saccharomyces cerevisiae
ctcgcattta

SEQ ID NO: 8126 - DNA, 10 bp, Saccharomyces cerevisiae
ctcgccgcac

SEQ ID NO: 8127 - DNA, 10 bp, Saccharomyces cerevisiae
ctcgccttca

SEQ ID NO: 8128 - DNA, 10 bp, Saccharomyces cerevisiae
ctcggcaata

SEQ ID NO: 8129 - DNA, 10 bp, Saccharomyces cerevisiae
ctcgggtcac

SEQ ID NO: 8130 - DNA, 10 bp, Saccharomyces cerevisiae
ctcggtaaat

SEQ ID NO: 8131 - DNA, 10 bp, Saccharomyces cerevisiae
ctcggtaagt

SEQ ID NO: 8132 - DNA, 10 bp, Saccharomyces cerevisiae
ctcgtttcca

SEQ ID NO: 8133 - DNA, 10 bp, Saccharomyces cerevisiae
ctctaaaaat

SEQ ID NO: 8134 - DNA, 10 bp, Saccharomyces cerevisiae
ctctaagaga

SEQ ID NO: 8135 - DNA, 10 bp, Saccharomyces cerevisiae
ctctaccgtc

SEQ ID NO: 8136 - DNA, 10 bp, Saccharomyces cerevisiae
ctctactgag

SEQ ID NO: 8137 - DNA, 10 bp, Saccharomyces cerevisiae
ctctactggc

SEQ ID NO: 8138 - DNA, 10 bp, Saccharomyces cerevisiae
ctctagaaaa

SEQ ID NO: 8139 - DNA, 10 bp, Saccharomyces cerevisiae
ctctagaaga

SEQ ID NO: 8140 - DNA, 10 bp, Saccharomyces cerevisiae
ctctagaagt

SEQ ID NO: 8141 - DNA, 10 bp, Saccharomyces cerevisiae
ctctagcaac

SEQ ID NO: 8142 - DNA, 10 bp, Saccharomyces cerevisiae
ctctagctcc

SEQ ID NO: 8143 - DNA, 10 bp, Saccharomyces cerevisiae
ctctataccg

SEQ ID NO: 8144 - DNA, 10 bp, Saccharomyces cerevisiae
ctctcatatc

SEQ ID NO: 8145 - DNA, 10 bp, Saccharomyces cerevisiae
ctctcattca

SEQ ID NO: 8146 - DNA, 10 bp, Saccharomyces cerevisiae
ctctccgaat

SEQ ID NO: 8147 - DNA, 10 bp, Saccharomyces cerevisiae
ctctcggtgt

SEQ ID NO: 8148 - DNA, 10 bp, Saccharomyces cerevisiae
ctctctattc

SEQ ID NO: 8149 - DNA, 10 bp, Saccharomyces cerevisiae
ctctctgtct

SEQ ID NO: 8150 - DNA, 10 bp, Saccharomyces cerevisiae
ctctgagata

SEQ ID NO: 8151 - DNA, 10 bp, Saccharomyces cerevisiae
ctctgatact

SEQ ID NO: 8152 - DNA, 10 bp, Saccharomyces cerevisiae
ctctgccatc

SEQ ID NO: 8153 - DNA, 10 bp, Saccharomyces cerevisiae
ctcttaattg

SEQ ID NO: 8154 - DNA, 10 bp, Saccharomyces cerevisiae
ctcttactgt

SEQ ID NO: 8155 - DNA, 10 bp, Saccharomyces cerevisiae
ctcttcgcct

SEQ ID NO: 8156 - DNA, 10 bp, Saccharomyces cerevisiae
ctcttcttca

SEQ ID NO: 8157 - DNA, 10 bp, Saccharomyces cerevisiae
ctcttgggtt

SEQ ID NO: 8158 - DNA, 10 bp, Saccharomyces cerevisiae
ctcttgtgaa

SEQ ID NO: 8159 - DNA, 10 bp, Saccharomyces cerevisiae
ctctttagca

SEQ ID NO: 8160 - DNA, 10 bp, Saccharomyces cerevisiae
ctctttatac

SEQ ID NO: 8161 - DNA, 10 bp, Saccharomyces cerevisiae
ctctttcata

SEQ ID NO: 8162 - DNA, 10 bp, Saccharomyces cerevisiae
ctctttctat

SEQ ID NO: 8163 - DNA, 10 bp, Saccharomyces cerevisiae
ctctttgaaa

SEQ ID NO: 8164 - DNA, 10 bp, Saccharomyces cerevisiae
ctctttgaat

SEQ ID NO: 8165 - DNA, 10 bp, Saccharomyces cerevisiae
ctcttttgaa

SEQ ID NO: 8166 - DNA, 10 bp, Saccharomyces cerevisiae
ctgaaaaaag

SEQ ID NO: 8167 - DNA, 10 bp, Saccharomyces cerevisiae
ctgaaaaacc

SEQ ID NO: 8168 - DNA, 10 bp, Saccharomyces cerevisiae
ctgaaaacat

SEQ ID NO: 8169 - DNA, 10 bp, Saccharomyces cerevisiae
ctgaaaatat

SEQ ID NO: 8170 - DNA, 10 bp, Saccharomyces cerevisiae
ctgaaatact

SEQ ID NO: 8171 - DNA, 10 bp, Saccharomyces cerevisiae
ctgaaatata

SEQ ID NO: 8172 - DNA, 10 bp, Saccharomyces cerevisiae
ctgaaattat

SEQ ID NO: 8173 - DNA, 10 bp, Saccharomyces cerevisiae
ctgaaatttt

SEQ ID NO: 8174 - DNA, 10 bp, Saccharomyces cerevisiae
ctgaacgaag

SEQ ID NO: 8175 - DNA, 10 bp, Saccharomyces cerevisiae
ctgaactaca

SEQ ID NO: 8176 - DNA, 10 bp, Saccharomyces cerevisiae
ctgaactacc

SEQ ID NO: 8177 - DNA, 10 bp, Saccharomyces cerevisiae
ctgaagcagg

SEQ ID NO: 8178 - DNA, 10 bp, Saccharomyces cerevisiae
ctgaagcagt

SEQ ID NO: 8179 - DNA, 10 bp, Saccharomyces cerevisiae
ctgacaattt

SEQ ID NO: 8180 - DNA, 10 bp, Saccharomyces cerevisiae
ctgaccaaac

SEQ ID NO: 8181 - DNA, 10 bp, Saccharomyces cerevisiae
ctgacccctt

SEQ ID NO: 8182 - DNA, 10 bp, Saccharomyces cerevisiae
ctgacgggac

SEQ ID NO: 8183 - DNA, 10 bp, Saccharomyces cerevisiae
ctgaggggac

SEQ ID NO: 8184 - DNA, 10 bp, Saccharomyces cerevisiae
ctgatccgtg

SEQ ID NO: 8185 - DNA, 10 bp, Saccharomyces cerevisiae
ctgatggaac

SEQ ID NO: 8186 - DNA, 10 bp, Saccharomyces cerevisiae
ctgatttaga

SEQ ID NO: 8187 - DNA, 10 bp, Saccharomyces cerevisiae
ctgatttcaa

SEQ ID NO: 8188 - DNA, 10 bp, Saccharomyces cerevisiae
ctgcaagtag

SEQ ID NO: 8189 - DNA, 10 bp, Saccharomyces cerevisiae
ctgcacggta

SEQ ID NO: 8190 - DNA, 10 bp, Saccharomyces cerevisiae
ctgcactggc

SEQ ID NO: 8191 - DNA, 10 bp, Saccharomyces cerevisiae
ctgcagctaa

SEQ ID NO: 8192 - DNA, 10 bp, Saccharomyces cerevisiae
ctgcattaac

SEQ ID NO: 8193 - DNA, 10 bp, Saccharomyces cerevisiae
ctgcattaca

SEQ ID NO: 8194 - DNA, 10 bp, Saccharomyces cerevisiae
ctgccaagtg

SEQ ID NO: 8195 - DNA, 10 bp, Saccharomyces cerevisiae
ctgccaatgg

SEQ ID NO: 8196 - DNA, 10 bp, Saccharomyces cerevisiae
ctgccagaca

SEQ ID NO: 8197 - DNA, 10 bp, Saccharomyces cerevisiae
ctgccccggt

SEQ ID NO: 8198 - DNA, 10 bp, Saccharomyces cerevisiae
ctgccctcgg

SEQ ID NO: 8199 - DNA, 10 bp, Saccharomyces cerevisiae
ctgccctggg

SEQ ID NO: 8200 - DNA, 10 bp, Saccharomyces cerevisiae
ctgccggtga

SEQ ID NO: 8201 - DNA, 10 bp, Saccharomyces cerevisiae
ctgcctcagc

SEQ ID NO: 8202 - DNA, 10 bp, Saccharomyces cerevisiae
ctgcctccac

SEQ ID NO: 8203 - DNA, 10 bp, Saccharomyces cerevisiae
ctgccttaca

SEQ ID NO: 8204 - DNA, 10 bp, Saccharomyces cerevisiae
ctgcgatttt

SEQ ID NO: 8205 - DNA, 10 bp, Saccharomyces cerevisiae
ctgcggattc

SEQ ID NO: 8206 - DNA, 10 bp, Saccharomyces cerevisiae
ctgcggcact

SEQ ID NO: 8207 - DNA, 10 bp, Saccharomyces cerevisiae
ctgcgttacc

SEQ ID NO: 8208 - DNA, 10 bp, Saccharomyces cerevisiae
ctgcgtttct

SEQ ID NO: 8209 - DNA, 10 bp, Saccharomyces cerevisiae
ctgctaacgg

SEQ ID NO: 8210 - DNA, 10 bp, Saccharomyces cerevisiae
ctgctatatt

SEQ ID NO: 8211 - DNA, 10 bp, Saccharomyces cerevisiae
ctgctatgca

SEQ ID NO: 8212 - DNA, 10 bp, Saccharomyces cerevisiae
ctgctcaaat

SEQ ID NO: 8213 - DNA, 10 bp, Saccharomyces cerevisiae
ctgctcaggg

SEQ ID NO: 8214 - DNA, 10 bp, Saccharomyces cerevisiae
ctgctctagg

SEQ ID NO: 8215 - DNA, 10 bp, Saccharomyces cerevisiae
ctgctctcgg

SEQ ID NO: 8216 - DNA, 10 bp, Saccharomyces cerevisiae
ctgctctgga

SEQ ID NO: 8217 - DNA, 10 bp, Saccharomyces cerevisiae
ctgctcttga

SEQ ID NO: 8218 - DNA, 10 bp, Saccharomyces cerevisiae
ctgctggtgc

SEQ ID NO: 8219 - DNA, 10 bp, Saccharomyces cerevisiae
ctgcttaaaa

SEQ ID NO: 8220 - DNA, 10 bp, Saccharomyces cerevisiae
ctgcttcacg

SEQ ID NO: 8221 - DNA, 10 bp, Saccharomyces cerevisiae
ctgcttgctg

SEQ ID NO: 8222 - DNA, 10 bp, Saccharomyces cerevisiae
ctgcttttag

SEQ ID NO: 8223 - DNA, 10 bp, Saccharomyces cerevisiae
ctggaaaaaa

SEQ ID NO: 8224 - DNA, 10 bp, Saccharomyces cerevisiae
ctggaatgga

SEQ ID NO: 8225 - DNA, 10 bp, Saccharomyces cerevisiae
ctggaccaat

SEQ ID NO: 8226 - DNA, 10 bp, Saccharomyces cerevisiae
ctggagggaa

SEQ ID NO: 8227 - DNA, 10 bp, Saccharomyces cerevisiae
ctggatataa

SEQ ID NO: 8228 - DNA, 10 bp, Saccharomyces cerevisiae
ctggatggga

SEQ ID NO: 8229 - DNA, 10 bp, Saccharomyces cerevisiae
ctggcataac

SEQ ID NO: 8230 - DNA, 10 bp, Saccharomyces cerevisiae
ctggccaaaa

SEQ ID NO: 8231 - DNA, 10 bp, Saccharomyces cerevisiae
ctggccagaa

SEQ ID NO: 8232 - DNA, 10 bp, Saccharomyces cerevisiae
ctggcctggg

SEQ ID NO: 8233 - DNA, 10 bp, Saccharomyces cerevisiae
ctggcgaacc

SEQ ID NO: 8234 - DNA, 10 bp, Saccharomyces cerevisiae
ctggctcctt

SEQ ID NO: 8235 - DNA, 10 bp, Saccharomyces cerevisiae
ctggctctgg

SEQ ID NO: 8236 - DNA, 10 bp, Saccharomyces cerevisiae
ctgggtagtg

SEQ ID NO: 8237 - DNA, 10 bp, Saccharomyces cerevisiae
ctgggtccca

SEQ ID NO: 8238 - DNA, 10 bp, Saccharomyces cerevisiae
ctgggtgggc

SEQ ID NO: 8239 - DNA, 10 bp, Saccharomyces cerevisiae
ctggtaaaat

SEQ ID NO: 8240 - DNA, 10 bp, Saccharomyces cerevisiae
ctggtattgc

SEQ ID NO: 8241 - DNA, 10 bp, Saccharomyces cerevisiae
ctggtcaaaa

SEQ ID NO: 8242 - DNA, 10 bp, Saccharomyces cerevisiae
ctggtgaagc

SEQ ID NO: 8243 - DNA, 10 bp, Saccharomyces cerevisiae
ctggtgctag

SEQ ID NO: 8244 - DNA, 10 bp, Saccharomyces cerevisiae
ctggtgctca

SEQ ID NO: 8245 - DNA, 10 bp, Saccharomyces cerevisiae
ctggttatta

SEQ ID NO: 8246 - DNA, 10 bp, Saccharomyces cerevisiae
ctggttgcac

SEQ ID NO: 8247 - DNA, 10 bp, Saccharomyces cerevisiae
ctggtttatt

SEQ ID NO: 8248 - DNA, 10 bp, Saccharomyces cerevisiae
ctggtttttg

SEQ ID NO: 8249 - DNA, 10 bp, Saccharomyces cerevisiae
ctgtaagtct

SEQ ID NO: 8250 - DNA, 10 bp, Saccharomyces cerevisiae
ctgtatatcg

SEQ ID NO: 8251 - DNA, 10 bp, Saccharomyces cerevisiae
ctgtatcggc

SEQ ID NO: 8252 - DNA, 10 bp, Saccharomyces cerevisiae
ctgtatctga

SEQ ID NO: 8253 - DNA, 10 bp, Saccharomyces cerevisiae
ctgtatgttc

SEQ ID NO: 8254 - DNA, 10 bp, Saccharomyces cerevisiae
ctgtatttca

SEQ ID NO: 8255 - DNA, 10 bp, Saccharomyces cerevisiae
ctgtccctga

SEQ ID NO: 8256 - DNA, 10 bp, Saccharomyces cerevisiae
ctgtcccttg

SEQ ID NO: 8257 - DNA, 10 bp, Saccharomyces cerevisiae
ctgtcctgaa

SEQ ID NO: 8258 - DNA, 10 bp, Saccharomyces cerevisiae
ctgtcgagga

SEQ ID NO: 8259 - DNA, 10 bp, Saccharomyces cerevisiae
ctgtcgtttg

SEQ ID NO: 8260 - DNA, 10 bp, Saccharomyces cerevisiae
ctgtctaacg

SEQ ID NO: 8261 - DNA, 10 bp, Saccharomyces cerevisiae
ctgtctcaga

SEQ ID NO: 8262 - DNA, 10 bp, Saccharomyces cerevisiae
ctgtctctca

SEQ ID NO: 8263 - DNA, 10 bp, Saccharomyces cerevisiae
ctgtgagcag

SEQ ID NO: 8264 - DNA, 10 bp, Saccharomyces cerevisiae
ctgtgatatc

SEQ ID NO: 8265 - DNA, 10 bp, Saccharomyces cerevisiae
ctgtgccgca

SEQ ID NO: 8266 - DNA, 10 bp, Saccharomyces cerevisiae
ctgtggtgaa

SEQ ID NO: 8267 - DNA, 10 bp, Saccharomyces cerevisiae
ctgtgttttt

SEQ ID NO: 8268 - DNA, 10 bp, Saccharomyces cerevisiae
ctgttactag

SEQ ID NO: 8269 - DNA, 10 bp, Saccharomyces cerevisiae
ctgttagtat

SEQ ID NO: 8270 - DNA, 10 bp, Saccharomyces cerevisiae
ctgttggtcg

SEQ ID NO: 8271 - DNA, 10 bp, Saccharomyces cerevisiae
ctgttgttgc

SEQ ID NO: 8272 - DNA, 10 bp, Saccharomyces cerevisiae
ctgtttggag

SEQ ID NO: 8273 - DNA, 10 bp, Saccharomyces cerevisiae
ctgttttctt

SEQ ID NO: 8274 - DNA, 10 bp, Saccharomyces cerevisiae
ctgttttgca

SEQ ID NO: 8275 - DNA, 10 bp, Saccharomyces cerevisiae
cttaaaattt

SEQ ID NO: 8276 - DNA, 10 bp, Saccharomyces cerevisiae
cttaaaccga

SEQ ID NO: 8277 - DNA, 10 bp, Saccharomyces cerevisiae
cttaaatctc

SEQ ID NO: 8278 - DNA, 10 bp, Saccharomyces cerevisiae
cttaacactc

SEQ ID NO: 8279 - DNA, 10 bp, Saccharomyces cerevisiae
cttaaccatt

SEQ ID NO: 8280 - DNA, 10 bp, Saccharomyces cerevisiae
cttaactaaa

SEQ ID NO: 8281 - DNA, 10 bp, Saccharomyces cerevisiae
cttaagacat

SEQ ID NO: 8282 - DNA, 10 bp, Saccharomyces cerevisiae
cttaagcagg

SEQ ID NO: 8283 - DNA, 10 bp, Saccharomyces cerevisiae
cttaagctgg

SEQ ID NO: 8284 - DNA, 10 bp, Saccharomyces cerevisiae
cttacattga

SEQ ID NO: 8285 - DNA, 10 bp, Saccharomyces cerevisiae
cttaccagtt

SEQ ID NO: 8286 - DNA, 10 bp, Saccharomyces cerevisiae
cttactcttc

SEQ ID NO: 8287 - DNA, 10 bp, Saccharomyces cerevisiae
cttacttagt

SEQ ID NO: 8288 - DNA, 10 bp, Saccharomyces cerevisiae
cttagcccag

SEQ ID NO: 8289 - DNA, 10 bp, Saccharomyces cerevisiae
cttataggca

SEQ ID NO: 8290 - DNA, 10 bp, Saccharomyces cerevisiae
cttatataga

SEQ ID NO: 8291 - DNA, 10 bp, Saccharomyces cerevisiae
cttatggagt

SEQ ID NO: 8292 - DNA, 10 bp, Saccharomyces cerevisiae
cttatttatt

SEQ ID NO: 8293 - DNA, 10 bp, Saccharomyces cerevisiae
cttatttcaa

SEQ ID NO: 8294 - DNA, 10 bp, Saccharomyces cerevisiae
cttcaaaaaa

SEQ ID NO: 8295 - DNA, 10 bp, Saccharomyces cerevisiae
cttcaaacca

SEQ ID NO: 8296 - DNA, 10 bp, Saccharomyces cerevisiae
cttcaacaac

SEQ ID NO: 8297 - DNA, 10 bp, Saccharomyces cerevisiae
cttcaactcc

SEQ ID NO: 8298 - DNA, 10 bp, Saccharomyces cerevisiae
cttcaattcc

SEQ ID NO: 8299 - DNA, 10 bp, Saccharomyces cerevisiae
cttcacattt

SEQ ID NO: 8300 - DNA, 10 bp, Saccharomyces cerevisiae
cttcacttga

SEQ ID NO: 8301 - DNA, 10 bp, Saccharomyces cerevisiae
cttcagtcca

SEQ ID NO: 8302 - DNA, 10 bp, Saccharomyces cerevisiae
cttcagtcgt

SEQ ID NO: 8303 - DNA, 10 bp, Saccharomyces cerevisiae
cttcattaac

SEQ ID NO: 8304 - DNA, 10 bp, Saccharomyces cerevisiae
cttccagctt

SEQ ID NO: 8305 - DNA, 10 bp, Saccharomyces cerevisiae
cttcccaggt

SEQ ID NO: 8306 - DNA, 10 bp, Saccharomyces cerevisiae
cttccgcgga

SEQ ID NO: 8307 - DNA, 10 bp, Saccharomyces cerevisiae
cttccttagg

SEQ ID NO: 8308 - DNA, 10 bp, Saccharomyces cerevisiae
cttcggaatt

SEQ ID NO: 8309 - DNA, 10 bp, Saccharomyces cerevisiae
cttcgtcttg

SEQ ID NO: 8310 - DNA, 10 bp, Saccharomyces cerevisiae
cttctacttt

SEQ ID NO: 8311 - DNA, 10 bp, Saccharomyces cerevisiae
cttctcaagt

SEQ ID NO: 8312 - DNA, 10 bp, Saccharomyces cerevisiae
cttctcgcag

SEQ ID NO: 8313 - DNA, 10 bp, Saccharomyces cerevisiae
cttctcgtta

SEQ ID NO: 8314 - DNA, 10 bp, Saccharomyces cerevisiae
cttctctggg

SEQ ID NO: 8315 - DNA, 10 bp, Saccharomyces cerevisiae
cttctgatgt

SEQ ID NO: 8316 - DNA, 10 bp, Saccharomyces cerevisiae
cttctgttca

SEQ ID NO: 8317 - DNA, 10 bp, Saccharomyces cerevisiae
cttcttatat

SEQ ID NO: 8318 - DNA, 10 bp, Saccharomyces cerevisiae
cttcttggcg

SEQ ID NO: 8319 - DNA, 10 bp, Saccharomyces cerevisiae
cttgaaagag

SEQ ID NO: 8320 - DNA, 10 bp, Saccharomyces cerevisiae
cttgaataca

SEQ ID NO: 8321 - DNA, 10 bp, Saccharomyces cerevisiae
cttgagaacc

SEQ ID NO: 8322 - DNA, 10 bp, Saccharomyces cerevisiae
cttgagaatc

SEQ ID NO: 8323 - DNA, 10 bp, Saccharomyces cerevisiae
cttgagatat

SEQ ID NO: 8324 - DNA, 10 bp, Saccharomyces cerevisiae
cttgagttgc

SEQ ID NO: 8325 - DNA, 10 bp, Saccharomyces cerevisiae
cttgataatc

SEQ ID NO: 8326 - DNA, 10 bp, Saccharomyces cerevisiae
cttgatgaat

SEQ ID NO: 8327 - DNA, 10 bp, Saccharomyces cerevisiae
cttgatgttt

SEQ ID NO: 8328 - DNA, 10 bp, Saccharomyces cerevisiae
cttgattatg

SEQ ID NO: 8329 - DNA, 10 bp, Saccharomyces cerevisiae
cttgcatctc

SEQ ID NO: 8330 - DNA, 10 bp, Saccharomyces cerevisiae
cttgcgacag

SEQ ID NO: 8331 - DNA, 10 bp, Saccharomyces cerevisiae
cttgctattt

SEQ ID NO: 8332 - DNA, 10 bp, Saccharomyces cerevisiae
cttgctccaa

SEQ ID NO: 8333 - DNA, 10 bp, Saccharomyces cerevisiae
cttgctggca

SEQ ID NO: 8334 - DNA, 10 bp, Saccharomyces cerevisiae
cttggagcag

SEQ ID NO: 8335 - DNA, 10 bp, Saccharomyces cerevisiae
cttggcatta

SEQ ID NO: 8336 - DNA, 10 bp, Saccharomyces cerevisiae
cttggctatt

SEQ ID NO: 8337 - DNA, 10 bp, Saccharomyces cerevisiae
cttgggaagc

SEQ ID NO: 8338 - DNA, 10 bp, Saccharomyces cerevisiae
cttggtggta

SEQ ID NO: 8339 - DNA, 10 bp, Saccharomyces cerevisiae
cttgtaatgg

SEQ ID NO: 8340 - DNA, 10 bp, Saccharomyces cerevisiae
cttgtatgga

SEQ ID NO: 8341 - DNA, 10 bp, Saccharomyces cerevisiae
cttgtatggt

SEQ ID NO: 8342 - DNA, 10 bp, Saccharomyces cerevisiae
cttgtatgtt

SEQ ID NO: 8343 - DNA, 10 bp, Saccharomyces cerevisiae
cttgtattac

SEQ ID NO: 8344 - DNA, 10 bp, Saccharomyces cerevisiae
cttgtctgtc

SEQ ID NO: 8345 - DNA, 10 bp, Saccharomyces cerevisiae
cttgttgctt

SEQ ID NO: 8346 - DNA, 10 bp, Saccharomyces cerevisiae
ctttaatttc

SEQ ID NO: 8347 - DNA, 10 bp, Saccharomyces cerevisiae
ctttacactc

SEQ ID NO: 8348 - DNA, 10 bp, Saccharomyces cerevisiae
ctttactttt

SEQ ID NO: 8349 - DNA, 10 bp, Saccharomyces cerevisiae
ctttataaaa

SEQ ID NO: 8350 - DNA, 10 bp, Saccharomyces cerevisiae
ctttataaag

SEQ ID NO: 8351 - DNA, 10 bp, Saccharomyces cerevisiae
ctttatacgt

SEQ ID NO: 8352 - DNA, 10 bp, Saccharomyces cerevisiae
ctttcatata

SEQ ID NO: 8353 - DNA, 10 bp, Saccharomyces cerevisiae
ctttcattga

SEQ ID NO: 8354 - DNA, 10 bp, Saccharomyces cerevisiae
ctttccaaac

SEQ ID NO: 8355 - DNA, 10 bp, Saccharomyces cerevisiae
ctttccaatc

SEQ ID NO: 8356 - DNA, 10 bp, Saccharomyces cerevisiae
ctttcgcacc

SEQ ID NO: 8357 - DNA, 10 bp, Saccharomyces cerevisiae
ctttcggaaa

SEQ ID NO: 8358 - DNA, 10 bp, Saccharomyces cerevisiae
ctttcgtaaa

SEQ ID NO: 8359 - DNA, 10 bp, Saccharomyces cerevisiae
ctttctcttg

SEQ ID NO: 8360 - DNA, 10 bp, Saccharomyces cerevisiae
ctttgaaaaa

SEQ ID NO: 8361 - DNA, 10 bp, Saccharomyces cerevisiae
ctttgaaagc

SEQ ID NO: 8362 - DNA, 10 bp, Saccharomyces cerevisiae
ctttgaaatg

SEQ ID NO: 8363 - DNA, 10 bp, Saccharomyces cerevisiae
ctttgaacga

SEQ ID NO: 8364 - DNA, 10 bp, Saccharomyces cerevisiae
ctttgccaaa

SEQ ID NO: 8365 - DNA, 10 bp, Saccharomyces cerevisiae
ctttgcccac

SEQ ID NO: 8366 - DNA, 10 bp, Saccharomyces cerevisiae
ctttgctgct

SEQ ID NO: 8367 - DNA, 10 bp, Saccharomyces cerevisiae
ctttgcttac

SEQ ID NO: 8368 - DNA, 10 bp, Saccharomyces cerevisiae
ctttggaaca

SEQ ID NO: 8369 - DNA, 10 bp, Saccharomyces cerevisiae
ctttgtaata

SEQ ID NO: 8370 - DNA, 10 bp, Saccharomyces cerevisiae
ctttgtacaa

SEQ ID NO: 8371 - DNA, 10 bp, Saccharomyces cerevisiae
ctttgtatat

SEQ ID NO: 8372 - DNA, 10 bp, Saccharomyces cerevisiae
ctttgtatct

SEQ ID NO: 8373 - DNA, 10 bp, Saccharomyces cerevisiae
ctttgtctcc

SEQ ID NO: 8374 - DNA, 10 bp, Saccharomyces cerevisiae
ctttgtgact

SEQ ID NO: 8375 - DNA, 10 bp, Saccharomyces cerevisiae
cttttaaaaa

SEQ ID NO: 8376 - DNA, 10 bp, Saccharomyces cerevisiae
cttttaacac

SEQ ID NO: 8377 - DNA, 10 bp, Saccharomyces cerevisiae
cttttaagga

SEQ ID NO: 8378 - DNA, 10 bp, Saccharomyces cerevisiae
cttttagact

SEQ ID NO: 8379 - DNA, 10 bp, Saccharomyces cerevisiae
cttttaggaa

SEQ ID NO: 8380 - DNA, 10 bp, Saccharomyces cerevisiae
cttttcagct

SEQ ID NO: 8381 - DNA, 10 bp, Saccharomyces cerevisiae
cttttcatac

SEQ ID NO: 8382 - DNA, 10 bp, Saccharomyces cerevisiae
cttttctaga

SEQ ID NO: 8383 - DNA, 10 bp, Saccharomyces cerevisiae
cttttcttcc

SEQ ID NO: 8384 - DNA, 10 bp, Saccharomyces cerevisiae
cttttgaaga

SEQ ID NO: 8385 - DNA, 10 bp, Saccharomyces cerevisiae
cttttgttct

SEQ ID NO: 8386 - DNA, 10 bp, Saccharomyces cerevisiae
ctttttcata

SEQ ID NO: 8387 - DNA, 10 bp, Saccharomyces cerevisiae
ctttttctcg

SEQ ID NO: 8388 - DNA, 10 bp, Saccharomyces cerevisiae
ctttttggaa

SEQ ID NO: 8389 - DNA, 10 bp, Saccharomyces cerevisiae
cttttttatt

SEQ ID NO: 8390 - DNA, 10 bp, Saccharomyces cerevisiae
gaaaaaaaga

SEQ ID NO: 8391 - DNA, 10 bp, Saccharomyces cerevisiae
gaaaaaacat

SEQ ID NO: 8392 - DNA, 10 bp, Saccharomyces cerevisiae
gaaaaaacca

SEQ ID NO: 8393 - DNA, 10 bp, Saccharomyces cerevisiae
gaaaaaactt

SEQ ID NO: 8394 - DNA, 10 bp, Saccharomyces cerevisiae
gaaaaaagtt

SEQ ID NO: 8395 - DNA, 10 bp, Saccharomyces cerevisiae
gaaaaacatt

SEQ ID NO: 8396 - DNA, 10 bp, Saccharomyces cerevisiae
gaaaaacctc

SEQ ID NO: 8397 - DNA, 10 bp, Saccharomyces cerevisiae
gaaaaagacg

SEQ ID NO: 8398 - DNA, 10 bp, Saccharomyces cerevisiae
gaaaaattga

SEQ ID NO: 8399 - DNA, 10 bp, Saccharomyces cerevisiae
gaaaaattgg

SEQ ID NO: 8400 - DNA, 10 bp, Saccharomyces cerevisiae
gaaaacacct

SEQ ID NO: 8401 - DNA, 10 bp, Saccharomyces cerevisiae
gaaaacacta

SEQ ID NO: 8402 - DNA, 10 bp, Saccharomyces cerevisiae
gaaaacactc

SEQ ID NO: 8403 - DNA, 10 bp, Saccharomyces cerevisiae
gaaaacatcc

SEQ ID NO: 8404 - DNA, 10 bp, Saccharomyces cerevisiae
gaaaacatta

SEQ ID NO: 8405 - DNA, 10 bp, Saccharomyces cerevisiae
gaaaacattt

SEQ ID NO: 8406 - DNA, 10 bp, Saccharomyces cerevisiae
gaaaaccatc

SEQ ID NO: 8407 - DNA, 10 bp, Saccharomyces cerevisiae
gaaaacgtat

SEQ ID NO: 8408 - DNA, 10 bp, Saccharomyces cerevisiae
gaaaactgga

SEQ ID NO: 8409 - DNA, 10 bp, Saccharomyces cerevisiae
gaaaactggt

SEQ ID NO: 8410 - DNA, 10 bp, Saccharomyces cerevisiae
gaaaacttga

SEQ ID NO: 8411 - DNA, 10 bp, Saccharomyces cerevisiae
gaaaactttg

SEQ ID NO: 8412 - DNA, 10 bp, Saccharomyces cerevisiae
gaaaagagca

SEQ ID NO: 8413 - DNA, 10 bp, Saccharomyces cerevisiae
gaaaagatta

SEQ ID NO: 8414 - DNA, 10 bp, Saccharomyces cerevisiae
gaaaagctag

SEQ ID NO: 8415 - DNA, 10 bp, Saccharomyces cerevisiae
gaaaaggccc

SEQ ID NO: 8416 - DNA, 10 bp, Saccharomyces cerevisiae
gaaaaggcgg

SEQ ID NO: 8417 - DNA, 10 bp, Saccharomyces cerevisiae
gaaaaggtta

SEQ ID NO: 8418 - DNA, 10 bp, Saccharomyces cerevisiae
gaaaagtacc

SEQ ID NO: 8419 - DNA, 10 bp, Saccharomyces cerevisiae
gaaaatacaa

SEQ ID NO: 8420 - DNA, 10 bp, Saccharomyces cerevisiae
gaaaatgacg

SEQ ID NO: 8421 - DNA, 10 bp, Saccharomyces cerevisiae
gaaaatgcaa

SEQ ID NO: 8422 - DNA, 10 bp, Saccharomyces cerevisiae
gaaaatgccc

SEQ ID NO: 8423 - DNA, 10 bp, Saccharomyces cerevisiae
gaaaatgtaa

SEQ ID NO: 8424 - DNA, 10 bp, Saccharomyces cerevisiae
gaaaattact

SEQ ID NO: 8425 - DNA, 10 bp, Saccharomyces cerevisiae
gaaaatttca

SEQ ID NO: 8426 - DNA, 10 bp, Saccharomyces cerevisiae
gaaacaaaac

SEQ ID NO: 8427 - DNA, 10 bp, Saccharomyces cerevisiae
gaaacaactc

SEQ ID NO: 8428 - DNA, 10 bp, Saccharomyces cerevisiae
gaaacaaggg

SEQ ID NO: 8429 - DNA, 10 bp, Saccharomyces cerevisiae
gaaacagtgt

SEQ ID NO: 8430 - DNA, 10 bp, Saccharomyces cerevisiae
gaaaccatat

SEQ ID NO: 8431 - DNA, 10 bp, Saccharomyces cerevisiae
gaaacccaaa

SEQ ID NO: 8432 - DNA, 10 bp, Saccharomyces cerevisiae
gaaaccggtg

SEQ ID NO: 8433 - DNA, 10 bp, Saccharomyces cerevisiae
gaaacctgga

SEQ ID NO: 8434 - DNA, 10 bp, Saccharomyces cerevisiae
gaaactcgcc

SEQ ID NO: 8435 - DNA, 10 bp, Saccharomyces cerevisiae
gaaacttttt

SEQ ID NO: 8436 - DNA, 10 bp, Saccharomyces cerevisiae
gaaagaaaaa

SEQ ID NO: 8437 - DNA, 10 bp, Saccharomyces cerevisiae
gaaagaagcg

SEQ ID NO: 8438 - DNA, 10 bp, Saccharomyces cerevisiae
gaaagaagct

SEQ ID NO: 8439 - DNA, 10 bp, Saccharomyces cerevisiae
gaaagacaga

SEQ ID NO: 8440 - DNA, 10 bp, Saccharomyces cerevisiae
gaaagagctg

SEQ ID NO: 8441 - DNA, 10 bp, Saccharomyces cerevisiae
gaaagagttt

SEQ ID NO: 8442 - DNA, 10 bp, Saccharomyces cerevisiae
gaaagattgc

SEQ ID NO: 8443 - DNA, 10 bp, Saccharomyces cerevisiae
gaaagatttt

SEQ ID NO: 8444 - DNA, 10 bp, Saccharomyces cerevisiae
gaaagcatct

SEQ ID NO: 8445 - DNA, 10 bp, Saccharomyces cerevisiae
gaaagccggt

SEQ ID NO: 8446 - DNA, 10 bp, Saccharomyces cerevisiae
gaaagccttt

SEQ ID NO: 8447 - DNA, 10 bp, Saccharomyces cerevisiae
gaaagctttc

SEQ ID NO: 8448 - DNA, 10 bp, Saccharomyces cerevisiae
gaaagtacaa

SEQ ID NO: 8449 - DNA, 10 bp, Saccharomyces cerevisiae
gaaagttaga

SEQ ID NO: 8450 - DNA, 10 bp, Saccharomyces cerevisiae
gaaagttcgg

SEQ ID NO: 8451 - DNA, 10 bp, Saccharomyces cerevisiae
gaaagtttaa

SEQ ID NO: 8452 - DNA, 10 bp, Saccharomyces cerevisiae
gaaataagaa

SEQ ID NO: 8453 - DNA, 10 bp, Saccharomyces cerevisiae
gaaatatgta

SEQ ID NO: 8454 - DNA, 10 bp, Saccharomyces cerevisiae
gaaatcaaca

SEQ ID NO: 8455 - DNA, 10 bp, Saccharomyces cerevisiae
gaaatcagtg

SEQ ID NO: 8456 - DNA, 10 bp, Saccharomyces cerevisiae
gaaatccaat

SEQ ID NO: 8457 - DNA, 10 bp, Saccharomyces cerevisiae
gaaatcgggt

SEQ ID NO: 8458 - DNA, 10 bp, Saccharomyces cerevisiae
gaaatctgct

SEQ ID NO: 8459 - DNA, 10 bp, Saccharomyces cerevisiae
gaaatctggg

SEQ ID NO: 8460 - DNA, 10 bp, Saccharomyces cerevisiae
gaaatcttcg

SEQ ID NO: 8461 - DNA, 10 bp, Saccharomyces cerevisiae
gaaatgacat

SEQ ID NO: 8462 - DNA, 10 bp, Saccharomyces cerevisiae
gaaatggaat

SEQ ID NO: 8463 - DNA, 10 bp, Saccharomyces cerevisiae
gaaatggagg

SEQ ID NO: 8464 - DNA, 10 bp, Saccharomyces cerevisiae
gaaatggtac

SEQ ID NO: 8465 - DNA, 10 bp, Saccharomyces cerevisiae
gaaattaggg

SEQ ID NO: 8466 - DNA, 10 bp, Saccharomyces cerevisiae
gaaattgatg

SEQ ID NO: 8467 - DNA, 10 bp, Saccharomyces cerevisiae
gaacaaaaca

SEQ ID NO: 8468 - DNA, 10 bp, Saccharomyces cerevisiae
gaacaaagtt

SEQ ID NO: 8469 - DNA, 10 bp, Saccharomyces cerevisiae
gaacaaggaa

SEQ ID NO: 8470 - DNA, 10 bp, Saccharomyces cerevisiae
gaacaatgtt

SEQ ID NO: 8471 - DNA, 10 bp, Saccharomyces cerevisiae
gaacaattat

SEQ ID NO: 8472 - DNA, 10 bp, Saccharomyces cerevisiae
gaacacatct

SEQ ID NO: 8473 - DNA, 10 bp, Saccharomyces cerevisiae
gaacacctct

SEQ ID NO: 8474 - DNA, 10 bp, Saccharomyces cerevisiae
gaacactcct

SEQ ID NO: 8475 - DNA, 10 bp, Saccharomyces cerevisiae
gaacactgct

SEQ ID NO: 8476 - DNA, 10 bp, Saccharomyces cerevisiae
gaacacttag

SEQ ID NO: 8477 - DNA, 10 bp, Saccharomyces cerevisiae
gaacacttca

SEQ ID NO: 8478 - DNA, 10 bp, Saccharomyces cerevisiae
gaacacttcc

SEQ ID NO: 8479 - DNA, 10 bp, Saccharomyces cerevisiae
gaacacttgt

SEQ ID NO: 8480 - DNA, 10 bp, Saccharomyces cerevisiae
gaacactttt

SEQ ID NO: 8481 - DNA, 10 bp, Saccharomyces cerevisiae
gaacagacca

SEQ ID NO: 8482 - DNA, 10 bp, Saccharomyces cerevisiae
gaacaggtag

SEQ ID NO: 8483 - DNA, 10 bp, Saccharomyces cerevisiae
gaacagtagt

SEQ ID NO: 8484 - DNA, 10 bp, Saccharomyces cerevisiae
gaacagtgcc

SEQ ID NO: 8485 - DNA, 10 bp, Saccharomyces cerevisiae
gaacatctct

SEQ ID NO: 8486 - DNA, 10 bp, Saccharomyces cerevisiae
gaacattcta

SEQ ID NO: 8487 - DNA, 10 bp, Saccharomyces cerevisiae
gaacatttct

SEQ ID NO: 8488 - DNA, 10 bp, Saccharomyces cerevisiae
gaaccagttc

SEQ ID NO: 8489 - DNA, 10 bp, Saccharomyces cerevisiae
gaacccaatg

SEQ ID NO: 8490 - DNA, 10 bp, Saccharomyces cerevisiae
gaaccgattt

SEQ ID NO: 8491 - DNA, 10 bp, Saccharomyces cerevisiae
gaaccgctaa

SEQ ID NO: 8492 - DNA, 10 bp, Saccharomyces cerevisiae
gaaccggtga

SEQ ID NO: 8493 - DNA, 10 bp, Saccharomyces cerevisiae
gaacctgcca

SEQ ID NO: 8494 - DNA, 10 bp, Saccharomyces cerevisiae
gaacctgccg

SEQ ID NO: 8495 - DNA, 10 bp, Saccharomyces cerevisiae
gaacgacctg

SEQ ID NO: 8496 - DNA, 10 bp, Saccharomyces cerevisiae
gaacgagcat

SEQ ID NO: 8497 - DNA, 10 bp, Saccharomyces cerevisiae
gaacgaggtt

SEQ ID NO: 8498 - DNA, 10 bp, Saccharomyces cerevisiae
gaacgatata

SEQ ID NO: 8499 - DNA, 10 bp, Saccharomyces cerevisiae
gaacgcatac

SEQ ID NO: 8500 - DNA, 10 bp, Saccharomyces cerevisiae
gaacgcatct

SEQ ID NO: 8501 - DNA, 10 bp, Saccharomyces cerevisiae
gaacgcttta

SEQ ID NO: 8502 - DNA, 10 bp, Saccharomyces cerevisiae
gaacggacaa

SEQ ID NO: 8503 - DNA, 10 bp, Saccharomyces cerevisiae
gaacggagac

SEQ ID NO: 8504 - DNA, 10 bp, Saccharomyces cerevisiae
gaacggctct

SEQ ID NO: 8505 - DNA, 10 bp, Saccharomyces cerevisiae
gaacgggata

SEQ ID NO: 8506 - DNA, 10 bp, Saccharomyces cerevisiae
gaacgtgaac

SEQ ID NO: 8507 - DNA, 10 bp, Saccharomyces cerevisiae
gaactaaact

SEQ ID NO: 8508 - DNA, 10 bp, Saccharomyces cerevisiae
gaactccaga

SEQ ID NO: 8509 - DNA, 10 bp, Saccharomyces cerevisiae
gaactgatag

SEQ ID NO: 8510 - DNA, 10 bp, Saccharomyces cerevisiae
gaactggtgc

SEQ ID NO: 8511 - DNA, 10 bp, Saccharomyces cerevisiae
gaacttgccg

SEQ ID NO: 8512 - DNA, 10 bp, Saccharomyces cerevisiae
gaactttaca

SEQ ID NO: 8513 - DNA, 10 bp, Saccharomyces cerevisiae
gaagaaaaaa

SEQ ID NO: 8514 - DNA, 10 bp, Saccharomyces cerevisiae
gaagaaatcg

SEQ ID NO: 8515 - DNA, 10 bp, Saccharomyces cerevisiae
gaagaagaac

SEQ ID NO: 8516 - DNA, 10 bp, Saccharomyces cerevisiae
gaagaagaag

SEQ ID NO: 8517 - DNA, 10 bp, Saccharomyces cerevisiae
gaagaagaga

SEQ ID NO: 8518 - DNA, 10 bp, Saccharomyces cerevisiae
gaagaattga

SEQ ID NO: 8519 - DNA, 10 bp, Saccharomyces cerevisiae
gaagaattgc

SEQ ID NO: 8520 - DNA, 10 bp, Saccharomyces cerevisiae
gaagaattgg

SEQ ID NO: 8521 - DNA, 10 bp, Saccharomyces cerevisiae
gaagacagag

SEQ ID NO: 8522 - DNA, 10 bp, Saccharomyces cerevisiae
gaagacatct

SEQ ID NO: 8523 - DNA, 10 bp, Saccharomyces cerevisiae
gaagacctgc

SEQ ID NO: 8524 - DNA, 10 bp, Saccharomyces cerevisiae
gaagacggtt

SEQ ID NO: 8525 - DNA, 10 bp, Saccharomyces cerevisiae
gaagacgtgg

SEQ ID NO: 8526 - DNA, 10 bp, Saccharomyces cerevisiae
gaagactggt

SEQ ID NO: 8527 - DNA, 10 bp, Saccharomyces cerevisiae
gaagactgtc

SEQ ID NO: 8528 - DNA, 10 bp, Saccharomyces cerevisiae
gaagagagtg

SEQ ID NO: 8529 - DNA, 10 bp, Saccharomyces cerevisiae
gaagagatcg

SEQ ID NO: 8530 - DNA, 10 bp, Saccharomyces cerevisiae
gaagagcgag

SEQ ID NO: 8531 - DNA, 10 bp, Saccharomyces cerevisiae
gaagagcggt

SEQ ID NO: 8532 - DNA, 10 bp, Saccharomyces cerevisiae
gaagagtaaa

SEQ ID NO: 8533 - DNA, 10 bp, Saccharomyces cerevisiae
gaagatatct

SEQ ID NO: 8534 - DNA, 10 bp, Saccharomyces cerevisiae
gaagatattg

SEQ ID NO: 8535 - DNA, 10 bp, Saccharomyces cerevisiae
gaagatcctt

SEQ ID NO: 8536 - DNA, 10 bp, Saccharomyces cerevisiae
gaagattagc

SEQ ID NO: 8537 - DNA, 10 bp, Saccharomyces cerevisiae
gaagcagcac

SEQ ID NO: 8538 - DNA, 10 bp, Saccharomyces cerevisiae
gaagccatcg

SEQ ID NO: 8539 - DNA, 10 bp, Saccharomyces cerevisiae
gaagccctcc

SEQ ID NO: 8540 - DNA, 10 bp, Saccharomyces cerevisiae
gaagccgtaa

SEQ ID NO: 8541 - DNA, 10 bp, Saccharomyces cerevisiae
gaagcctgag

SEQ ID NO: 8542 - DNA, 10 bp, Saccharomyces cerevisiae
gaagctatca

SEQ ID NO: 8543 - DNA, 10 bp, Saccharomyces cerevisiae
gaagcttttg

SEQ ID NO: 8544 - DNA, 10 bp, Saccharomyces cerevisiae
gaaggaaagc

SEQ ID NO: 8545 - DNA, 10 bp, Saccharomyces cerevisiae
gaaggaagca

SEQ ID NO: 8546 - DNA, 10 bp, Saccharomyces cerevisiae
gaaggacgtg

SEQ ID NO: 8547 - DNA, 10 bp, Saccharomyces cerevisiae
gaaggatggg

SEQ ID NO: 8548 - DNA, 10 bp, Saccharomyces cerevisiae
gaaggattag

SEQ ID NO: 8549 - DNA, 10 bp, Saccharomyces cerevisiae
gaaggattta

SEQ ID NO: 8550 - DNA, 10 bp, Saccharomyces cerevisiae
gaaggatttg

SEQ ID NO: 8551 - DNA, 10 bp, Saccharomyces cerevisiae
gaaggttatg

SEQ ID NO: 8552 - DNA, 10 bp, Saccharomyces cerevisiae
gaaggtttcc

SEQ ID NO: 8553 - DNA, 10 bp, Saccharomyces cerevisiae
gaagtacaat

SEQ ID NO: 8554 - DNA, 10 bp, Saccharomyces cerevisiae
gaagtacagg

SEQ ID NO: 8555 - DNA, 10 bp, Saccharomyces cerevisiae
gaagtagagg

SEQ ID NO: 8556 - DNA, 10 bp, Saccharomyces cerevisiae
gaagtagcac

SEQ ID NO: 8557 - DNA, 10 bp, Saccharomyces cerevisiae
gaagtattag

SEQ ID NO: 8558 - DNA, 10 bp, Saccharomyces cerevisiae
gaagtcgctt

SEQ ID NO: 8559 - DNA, 10 bp, Saccharomyces cerevisiae
gaagtgtttt

SEQ ID NO: 8560 - DNA, 10 bp, Saccharomyces cerevisiae
gaagttatta

SEQ ID NO: 8561 - DNA, 10 bp, Saccharomyces cerevisiae
gaagttgtaa

SEQ ID NO: 8562 - DNA, 10 bp, Saccharomyces cerevisiae
gaataaaagt

SEQ ID NO: 8563 - DNA, 10 bp, Saccharomyces cerevisiae
gaataagaat

SEQ ID NO: 8564 - DNA, 10 bp, Saccharomyces cerevisiae
gaataataag

SEQ ID NO: 8565 - DNA, 10 bp, Saccharomyces cerevisiae
gaataatttg

SEQ ID NO: 8566 - DNA, 10 bp, Saccharomyces cerevisiae
gaatacagca

SEQ ID NO: 8567 - DNA, 10 bp, Saccharomyces cerevisiae
gaataccata

SEQ ID NO: 8568 - DNA, 10 bp, Saccharomyces cerevisiae
gaatacgaat

SEQ ID NO: 8569 - DNA, 10 bp, Saccharomyces cerevisiae
gaatactaaa

SEQ ID NO: 8570 - DNA, 10 bp, Saccharomyces cerevisiae
gaatactact

SEQ ID NO: 8571 - DNA, 10 bp, Saccharomyces cerevisiae
gaatactagg

SEQ ID NO: 8572 - DNA, 10 bp, Saccharomyces cerevisiae
gaatacttaa

SEQ ID NO: 8573 - DNA, 10 bp, Saccharomyces cerevisiae
gaatacttct

SEQ ID NO: 8574 - DNA, 10 bp, Saccharomyces cerevisiae
gaatagggat

SEQ ID NO: 8575 - DNA, 10 bp, Saccharomyces cerevisiae
gaatagggct

SEQ ID NO: 8576 - DNA, 10 bp, Saccharomyces cerevisiae
gaatatatta

SEQ ID NO: 8577 - DNA, 10 bp, Saccharomyces cerevisiae
gaatatggac

SEQ ID NO: 8578 - DNA, 10 bp, Saccharomyces cerevisiae
gaatccaaaa

SEQ ID NO: 8579 - DNA, 10 bp, Saccharomyces cerevisiae
gaatccaata

SEQ ID NO: 8580 - DNA, 10 bp, Saccharomyces cerevisiae
gaatcggcat

SEQ ID NO: 8581 - DNA, 10 bp, Saccharomyces cerevisiae
gaatctctca

SEQ ID NO: 8582 - DNA, 10 bp, Saccharomyces cerevisiae
gaatctggaa

SEQ ID NO: 8583 - DNA, 10 bp, Saccharomyces cerevisiae
gaatctggta

SEQ ID NO: 8584 - DNA, 10 bp, Saccharomyces cerevisiae
gaatcttgaa

SEQ ID NO: 8585 - DNA, 10 bp, Saccharomyces cerevisiae
gaatgaattt

SEQ ID NO: 8586 - DNA, 10 bp, Saccharomyces cerevisiae
gaatgataga

SEQ ID NO: 8587 - DNA, 10 bp, Saccharomyces cerevisiae
gaatgcaaaa

SEQ ID NO: 8588 - DNA, 10 bp, Saccharomyces cerevisiae
gaatgcacaa

SEQ ID NO: 8589 - DNA, 10 bp, Saccharomyces cerevisiae
gaatgcttac

SEQ ID NO: 8590 - DNA, 10 bp, Saccharomyces cerevisiae
gaatggaacc

SEQ ID NO: 8591 - DNA, 10 bp, Saccharomyces cerevisiae
gaatggagaa

SEQ ID NO: 8592 - DNA, 10 bp, Saccharomyces cerevisiae
gaatgggacg

SEQ ID NO: 8593 - DNA, 10 bp, Saccharomyces cerevisiae
gaatgggtta

SEQ ID NO: 8594 - DNA, 10 bp, Saccharomyces cerevisiae
gaatgggttt

SEQ ID NO: 8595 - DNA, 10 bp, Saccharomyces cerevisiae
gaatgtgatg

SEQ ID NO: 8596 - DNA, 10 bp, Saccharomyces cerevisiae
gaattaccaa

SEQ ID NO: 8597 - DNA, 10 bp, Saccharomyces cerevisiae
gaattactta

SEQ ID NO: 8598 - DNA, 10 bp, Saccharomyces cerevisiae
gaattagggg

SEQ ID NO: 8599 - DNA, 10 bp, Saccharomyces cerevisiae
gaattcctat

SEQ ID NO: 8600 - DNA, 10 bp, Saccharomyces cerevisiae
gaattcggta

SEQ ID NO: 8601 - DNA, 10 bp, Saccharomyces cerevisiae
gaattgacag

SEQ ID NO: 8602 - DNA, 10 bp, Saccharomyces cerevisiae
gaattgacgg

SEQ ID NO: 8603 - DNA, 10 bp, Saccharomyces cerevisiae
gaattgagag

SEQ ID NO: 8604 - DNA, 10 bp, Saccharomyces cerevisiae
gaattgagtt

SEQ ID NO: 8605 - DNA, 10 bp, Saccharomyces cerevisiae
gaatttgaaa

SEQ ID NO: 8606 - DNA, 10 bp, Saccharomyces cerevisiae
gaatttgctt

SEQ ID NO: 8607 - DNA, 10 bp, Saccharomyces cerevisiae
gacaactact

SEQ ID NO: 8608 - DNA, 10 bp, Saccharomyces cerevisiae
gacaactgct

SEQ ID NO: 8609 - DNA, 10 bp, Saccharomyces cerevisiae
gacaagaaaa

SEQ ID NO: 8610 - DNA, 10 bp, Saccharomyces cerevisiae
gacaaggagt

SEQ ID NO: 8611 - DNA, 10 bp, Saccharomyces cerevisiae
gacaagttgg

SEQ ID NO: 8612 - DNA, 10 bp, Saccharomyces cerevisiae
gacaatggta

SEQ ID NO: 8613 - DNA, 10 bp, Saccharomyces cerevisiae
gacacaatac

SEQ ID NO: 8614 - DNA, 10 bp, Saccharomyces cerevisiae
gacacagacc

SEQ ID NO: 8615 - DNA, 10 bp, Saccharomyces cerevisiae
gacacagacg

SEQ ID NO: 8616 - DNA, 10 bp, Saccharomyces cerevisiae
gacacccacc

SEQ ID NO: 8617 - DNA, 10 bp, Saccharomyces cerevisiae
gacaccgtga

SEQ ID NO: 8618 - DNA, 10 bp, Saccharomyces cerevisiae
gacagaaaac

SEQ ID NO: 8619 - DNA, 10 bp, Saccharomyces cerevisiae
gacagaactt

SEQ ID NO: 8620 - DNA, 10 bp, Saccharomyces cerevisiae
gacagaaggt

SEQ ID NO: 8621 - DNA, 10 bp, Saccharomyces cerevisiae
gacagatctc

SEQ ID NO: 8622 - DNA, 10 bp, Saccharomyces cerevisiae
gacagatctt

SEQ ID NO: 8623 - DNA, 10 bp, Saccharomyces cerevisiae
gacagccagg

SEQ ID NO: 8624 - DNA, 10 bp, Saccharomyces cerevisiae
gacagcttca

SEQ ID NO: 8625 - DNA, 10 bp, Saccharomyces cerevisiae
gacaggcttg

SEQ ID NO: 8626 - DNA, 10 bp, Saccharomyces cerevisiae
gacaggttcc

SEQ ID NO: 8627 - DNA, 10 bp, Saccharomyces cerevisiae
gacagtgatc

SEQ ID NO: 8628 - DNA, 10 bp, Saccharomyces cerevisiae
gacatacgtg

SEQ ID NO: 8629 - DNA, 10 bp, Saccharomyces cerevisiae
gacatatcat

SEQ ID NO: 8630 - DNA, 10 bp, Saccharomyces cerevisiae
gacatcaagg

SEQ ID NO: 8631 - DNA, 10 bp, Saccharomyces cerevisiae
gacatcgata

SEQ ID NO: 8632 - DNA, 10 bp, Saccharomyces cerevisiae
gacatctcga

SEQ ID NO: 8633 - DNA, 10 bp, Saccharomyces cerevisiae
gacatcttag

SEQ ID NO: 8634 - DNA, 10 bp, Saccharomyces cerevisiae
gacattactc

SEQ ID NO: 8635 - DNA, 10 bp, Saccharomyces cerevisiae
gacattggcc

SEQ ID NO: 8636 - DNA, 10 bp, Saccharomyces cerevisiae
gacattttcg

SEQ ID NO: 8637 - DNA, 10 bp, Saccharomyces cerevisiae
gacattttga

SEQ ID NO: 8638 - DNA, 10 bp, Saccharomyces cerevisiae
gaccaagaag

SEQ ID NO: 8639 - DNA, 10 bp, Saccharomyces cerevisiae
gaccactatt

SEQ ID NO: 8640 - DNA, 10 bp, Saccharomyces cerevisiae
gaccataaac

SEQ ID NO: 8641 - DNA, 10 bp, Saccharomyces cerevisiae
gaccattctc

SEQ ID NO: 8642 - DNA, 10 bp, Saccharomyces cerevisiae
gaccatttaa

SEQ ID NO: 8643 - DNA, 10 bp, Saccharomyces cerevisiae
gaccatttga

SEQ ID NO: 8644 - DNA, 10 bp, Saccharomyces cerevisiae
gacccaacag

SEQ ID NO: 8645 - DNA, 10 bp, Saccharomyces cerevisiae
gacccagatg

SEQ ID NO: 8646 - DNA, 10 bp, Saccharomyces cerevisiae
gacccagggc

SEQ ID NO: 8647 - DNA, 10 bp, Saccharomyces cerevisiae
gacccatcag

SEQ ID NO: 8648 - DNA, 10 bp, Saccharomyces cerevisiae
gacccccctt

SEQ ID NO: 8649 - DNA, 10 bp, Saccharomyces cerevisiae
gacccttccc

SEQ ID NO: 8650 - DNA, 10 bp, Saccharomyces cerevisiae
gaccgcacca

SEQ ID NO: 8651 - DNA, 10 bp, Saccharomyces cerevisiae
gaccgctaag

SEQ ID NO: 8652 - DNA, 10 bp, Saccharomyces cerevisiae
gaccggccag

SEQ ID NO: 8653 - DNA, 10 bp, Saccharomyces cerevisiae
gacctaagct

SEQ ID NO: 8654 - DNA, 10 bp, Saccharomyces cerevisiae
gacctactcc

SEQ ID NO: 8655 - DNA, 10 bp, Saccharomyces cerevisiae
gacctcactg

SEQ ID NO: 8656 - DNA, 10 bp, Saccharomyces cerevisiae
gacctcggag

SEQ ID NO: 8657 - DNA, 10 bp, Saccharomyces cerevisiae
gacctgaaaa

SEQ ID NO: 8658 - DNA, 10 bp, Saccharomyces cerevisiae
gacctgcgta

SEQ ID NO: 8659 - DNA, 10 bp, Saccharomyces cerevisiae
gaccttgcca

SEQ ID NO: 8660 - DNA, 10 bp, Saccharomyces cerevisiae
gacgaaaggc

SEQ ID NO: 8661 - DNA, 10 bp, Saccharomyces cerevisiae
gacgaagaaa

SEQ ID NO: 8662 - DNA, 10 bp, Saccharomyces cerevisiae
gacgacaagc

SEQ ID NO: 8663 - DNA, 10 bp, Saccharomyces cerevisiae
gacgacctgc

SEQ ID NO: 8664 - DNA, 10 bp, Saccharomyces cerevisiae
gacgagcacc

SEQ ID NO: 8665 - DNA, 10 bp, Saccharomyces cerevisiae
gacgaggatg

SEQ ID NO: 8666 - DNA, 10 bp, Saccharomyces cerevisiae
gacgatataa

SEQ ID NO: 8667 - DNA, 10 bp, Saccharomyces cerevisiae
gacgatcttg

SEQ ID NO: 8668 - DNA, 10 bp, Saccharomyces cerevisiae
gacgatgcaa

SEQ ID NO: 8669 - DNA, 10 bp, Saccharomyces cerevisiae
gacgcacttt

SEQ ID NO: 8670 - DNA, 10 bp, Saccharomyces cerevisiae
gacgccatca

SEQ ID NO: 8671 - DNA, 10 bp, Saccharomyces cerevisiae
gacgctaata

SEQ ID NO: 8672 - DNA, 10 bp, Saccharomyces cerevisiae
gacgcttgga

SEQ ID NO: 8673 - DNA, 10 bp, Saccharomyces cerevisiae
gacggaataa

SEQ ID NO: 8674 - DNA, 10 bp, Saccharomyces cerevisiae
gacggaccat

SEQ ID NO: 8675 - DNA, 10 bp, Saccharomyces cerevisiae
gacgtagaaa

SEQ ID NO: 8676 - DNA, 10 bp, Saccharomyces cerevisiae
gacgtagaac

SEQ ID NO: 8677 - DNA, 10 bp, Saccharomyces cerevisiae
gacgtccatc

SEQ ID NO: 8678 - DNA, 10 bp, Saccharomyces cerevisiae
gacgtgaagg

SEQ ID NO: 8679 - DNA, 10 bp, Saccharomyces cerevisiae
gacgtggaaa

SEQ ID NO: 8680 - DNA, 10 bp, Saccharomyces cerevisiae
gacgtttaaa

SEQ ID NO: 8681 - DNA, 10 bp, Saccharomyces cerevisiae
gacgtttact

SEQ ID NO: 8682 - DNA, 10 bp, Saccharomyces cerevisiae
gactaaattt

SEQ ID NO: 8683 - DNA, 10 bp, Saccharomyces cerevisiae
gactaagcta

SEQ ID NO: 8684 - DNA, 10 bp, Saccharomyces cerevisiae
gactaccttc

SEQ ID NO: 8685 - DNA, 10 bp, Saccharomyces cerevisiae
gactagacaa

SEQ ID NO: 8686 - DNA, 10 bp, Saccharomyces cerevisiae
gactagagcg

SEQ ID NO: 8687 - DNA, 10 bp, Saccharomyces cerevisiae
gactagtttt

SEQ ID NO: 8688 - DNA, 10 bp, Saccharomyces cerevisiae
gactataccg

SEQ ID NO: 8689 - DNA, 10 bp, Saccharomyces cerevisiae
gactatttac

SEQ ID NO: 8690 - DNA, 10 bp, Saccharomyces cerevisiae
gactccggga

SEQ ID NO: 8691 - DNA, 10 bp, Saccharomyces cerevisiae
gactctcaag

SEQ ID NO: 8692 - DNA, 10 bp, Saccharomyces cerevisiae
gactcttatg

SEQ ID NO: 8693 - DNA, 10 bp, Saccharomyces cerevisiae
gactcttcgc

SEQ ID NO: 8694 - DNA, 10 bp, Saccharomyces cerevisiae
gactcttctc

SEQ ID NO: 8695 - DNA, 10 bp, Saccharomyces cerevisiae
gactgactca

SEQ ID NO: 8696 - DNA, 10 bp, Saccharomyces cerevisiae
gactgcaaaa

SEQ ID NO: 8697 - DNA, 10 bp, Saccharomyces cerevisiae
gactgcttgt

SEQ ID NO: 8698 - DNA, 10 bp, Saccharomyces cerevisiae
gactgtgctg

SEQ ID NO: 8699 - DNA, 10 bp, Saccharomyces cerevisiae
gacttacgta

SEQ ID NO: 8700 - DNA, 10 bp, Saccharomyces cerevisiae
gacttattgc

SEQ ID NO: 8701 - DNA, 10 bp, Saccharomyces cerevisiae
gacttccata

SEQ ID NO: 8702 - DNA, 10 bp, Saccharomyces cerevisiae
gacttcgaga

SEQ ID NO: 8703 - DNA, 10 bp, Saccharomyces cerevisiae
gacttcttgt

SEQ ID NO: 8704 - DNA, 10 bp, Saccharomyces cerevisiae
gacttgtatc

SEQ ID NO: 8705 - DNA, 10 bp, Saccharomyces cerevisiae
gacttgttga

SEQ ID NO: 8706 - DNA, 10 bp, Saccharomyces cerevisiae
gactttactt

SEQ ID NO: 8707 - DNA, 10 bp, Saccharomyces cerevisiae
gacttttgaa

SEQ ID NO: 8708 - DNA, 10 bp, Saccharomyces cerevisiae
gactttttca

SEQ ID NO: 8709 - DNA, 10 bp, Saccharomyces cerevisiae
gagaaaacaa

SEQ ID NO: 8710 - DNA, 10 bp, Saccharomyces cerevisiae
gagaaaaccg

SEQ ID NO: 8711 - DNA, 10 bp, Saccharomyces cerevisiae
gagaaagaca

SEQ ID NO: 8712 - DNA, 10 bp, Saccharomyces cerevisiae
gagaaattga

SEQ ID NO: 8713 - DNA, 10 bp, Saccharomyces cerevisiae
gagaaattgg

SEQ ID NO: 8714 - DNA, 10 bp, Saccharomyces cerevisiae
gagaacagaa

SEQ ID NO: 8715 - DNA, 10 bp, Saccharomyces cerevisiae
gagaacatct

SEQ ID NO: 8716 - DNA, 10 bp, Saccharomyces cerevisiae
gagaacgtaa

SEQ ID NO: 8717 - DNA, 10 bp, Saccharomyces cerevisiae
gagaagaacc

SEQ ID NO: 8718 - DNA, 10 bp, Saccharomyces cerevisiae
gagaagagct

SEQ ID NO: 8719 - DNA, 10 bp, Saccharomyces cerevisiae
gagaagccag

SEQ ID NO: 8720 - DNA, 10 bp, Saccharomyces cerevisiae
gagaagtatt

SEQ ID NO: 8721 - DNA, 10 bp, Saccharomyces cerevisiae
gagaatgcgt

SEQ ID NO: 8722 - DNA, 10 bp, Saccharomyces cerevisiae
gagacaactg

SEQ ID NO: 8723 - DNA, 10 bp, Saccharomyces cerevisiae
gagacacctt

SEQ ID NO: 8724 - DNA, 10 bp, Saccharomyces cerevisiae
gagacactca

SEQ ID NO: 8725 - DNA, 10 bp, Saccharomyces cerevisiae
gagaccattg

SEQ ID NO: 8726 - DNA, 10 bp, Saccharomyces cerevisiae
gagacggata

SEQ ID NO: 8727 - DNA, 10 bp, Saccharomyces cerevisiae
gagactggtt

SEQ ID NO: 8728 - DNA, 10 bp, Saccharomyces cerevisiae
gagacttgtc

SEQ ID NO: 8729 - DNA, 10 bp, Saccharomyces cerevisiae
gagagaaccc

SEQ ID NO: 8730 - DNA, 10 bp, Saccharomyces cerevisiae
gagagaaggc

SEQ ID NO: 8731 - DNA, 10 bp, Saccharomyces cerevisiae
gagagagatt

SEQ ID NO: 8732 - DNA, 10 bp, Saccharomyces cerevisiae
gagagagtgg

SEQ ID NO: 8733 - DNA, 10 bp, Saccharomyces cerevisiae
gagagatgat

SEQ ID NO: 8734 - DNA, 10 bp, Saccharomyces cerevisiae
gagagcaaaa

SEQ ID NO: 8735 - DNA, 10 bp, Saccharomyces cerevisiae
gagagcaaat

SEQ ID NO: 8736 - DNA, 10 bp, Saccharomyces cerevisiae
gagagcagaa

SEQ ID NO: 8737 - DNA, 10 bp, Saccharomyces cerevisiae
gagagccacc

SEQ ID NO: 8738 - DNA, 10 bp, Saccharomyces cerevisiae
gagagcgcaa

SEQ ID NO: 8739 - DNA, 10 bp, Saccharomyces cerevisiae
gagagctcac

SEQ ID NO: 8740 - DNA, 10 bp, Saccharomyces cerevisiae
gagaggagcc

SEQ ID NO: 8741 - DNA, 10 bp, Saccharomyces cerevisiae
gagagttcgg

SEQ ID NO: 8742 - DNA, 10 bp, Saccharomyces cerevisiae
gagatgctat

SEQ ID NO: 8743 - DNA, 10 bp, Saccharomyces cerevisiae
gagattagtc

SEQ ID NO: 8744 - DNA, 10 bp, Saccharomyces cerevisiae
gagcaaaaaa

SEQ ID NO: 8745 - DNA, 10 bp, Saccharomyces cerevisiae
gagcaaaagt

SEQ ID NO: 8746 - DNA, 10 bp, Saccharomyces cerevisiae
gagcaaatat

SEQ ID NO: 8747 - DNA, 10 bp, Saccharomyces cerevisiae
gagcaatccg

SEQ ID NO: 8748 - DNA, 10 bp, Saccharomyces cerevisiae
gagcagttgt

SEQ ID NO: 8749 - DNA, 10 bp, Saccharomyces cerevisiae
gagcatacgg

SEQ ID NO: 8750 - DNA, 10 bp, Saccharomyces cerevisiae
gagccaattt

SEQ ID NO: 8751 - DNA, 10 bp, Saccharomyces cerevisiae
gagccagctt

SEQ ID NO: 8752 - DNA, 10 bp, Saccharomyces cerevisiae
gagccctggc

SEQ ID NO: 8753 - DNA, 10 bp, Saccharomyces cerevisiae
gagccctgtt

SEQ ID NO: 8754 - DNA, 10 bp, Saccharomyces cerevisiae
gagccgtcca

SEQ ID NO: 8755 - DNA, 10 bp, Saccharomyces cerevisiae
gagccgttgt

SEQ ID NO: 8756 - DNA, 10 bp, Saccharomyces cerevisiae
gagcgaagta

SEQ ID NO: 8757 - DNA, 10 bp, Saccharomyces cerevisiae
gagcgacatc

SEQ ID NO: 8758 - DNA, 10 bp, Saccharomyces cerevisiae
gagcgcatta

SEQ ID NO: 8759 - DNA, 10 bp, Saccharomyces cerevisiae
gagcgcgatg

SEQ ID NO: 8760 - DNA, 10 bp, Saccharomyces cerevisiae
gagcgtataa

SEQ ID NO: 8761 - DNA, 10 bp, Saccharomyces cerevisiae
gagcgttggt

SEQ ID NO: 8762 - DNA, 10 bp, Saccharomyces cerevisiae
gagctaatga

SEQ ID NO: 8763 - DNA, 10 bp, Saccharomyces cerevisiae
gagctagatg

SEQ ID NO: 8764 - DNA, 10 bp, Saccharomyces cerevisiae
gagctccacc

SEQ ID NO: 8765 - DNA, 10 bp, Saccharomyces cerevisiae
gagctctgta

SEQ ID NO: 8766 - DNA, 10 bp, Saccharomyces cerevisiae
gagcttatta

SEQ ID NO: 8767 - DNA, 10 bp, Saccharomyces cerevisiae
gagcttgaga

SEQ ID NO: 8768 - DNA, 10 bp, Saccharomyces cerevisiae
gaggaaagta

SEQ ID NO: 8769 - DNA, 10 bp, Saccharomyces cerevisiae
gaggaaagtt

SEQ ID NO: 8770 - DNA, 10 bp, Saccharomyces cerevisiae
gaggaacagg

SEQ ID NO: 8771 - DNA, 10 bp, Saccharomyces cerevisiae
gaggaatgta

SEQ ID NO: 8772 - DNA, 10 bp, Saccharomyces cerevisiae
gaggaattca

SEQ ID NO: 8773 - DNA, 10 bp, Saccharomyces cerevisiae
gaggacacca

SEQ ID NO: 8774 - DNA, 10 bp, Saccharomyces cerevisiae
gaggacgccc

SEQ ID NO: 8775 - DNA, 10 bp, Saccharomyces cerevisiae
gaggacgcct

SEQ ID NO: 8776 - DNA, 10 bp, Saccharomyces cerevisiae
gaggacgtgg

SEQ ID NO: 8777 - DNA, 10 bp, Saccharomyces cerevisiae
gaggagattt

SEQ ID NO: 8778 - DNA, 10 bp, Saccharomyces cerevisiae
gaggaggcgg

SEQ ID NO: 8779 - DNA, 10 bp, Saccharomyces cerevisiae
gaggaggttg

SEQ ID NO: 8780 - DNA, 10 bp, Saccharomyces cerevisiae
gaggagttgc

SEQ ID NO: 8781 - DNA, 10 bp, Saccharomyces cerevisiae
gaggataaca

SEQ ID NO: 8782 - DNA, 10 bp, Saccharomyces cerevisiae
gaggatatcg

SEQ ID NO: 8783 - DNA, 10 bp, Saccharomyces cerevisiae
gaggatgagg

SEQ ID NO: 8784 - DNA, 10 bp, Saccharomyces cerevisiae
gaggatgtcg

SEQ ID NO: 8785 - DNA, 10 bp, Saccharomyces cerevisiae
gaggcaaaat

SEQ ID NO: 8786 - DNA, 10 bp, Saccharomyces cerevisiae
gaggcacctg

SEQ ID NO: 8787 - DNA, 10 bp, Saccharomyces cerevisiae
gaggcggaca

SEQ ID NO: 8788 - DNA, 10 bp, Saccharomyces cerevisiae
gaggcgtttt

SEQ ID NO: 8789 - DNA, 10 bp, Saccharomyces cerevisiae
gaggctgatc

SEQ ID NO: 8790 - DNA, 10 bp, Saccharomyces cerevisiae
gagggaaata

SEQ ID NO: 8791 - DNA, 10 bp, Saccharomyces cerevisiae
gagggataac

SEQ ID NO: 8792 - DNA, 10 bp, Saccharomyces cerevisiae
gagggattca

SEQ ID NO: 8793 - DNA, 10 bp, Saccharomyces cerevisiae
gagggattcg

SEQ ID NO: 8794 - DNA, 10 bp, Saccharomyces cerevisiae
gagggctctg

SEQ ID NO: 8795 - DNA, 10 bp, Saccharomyces cerevisiae
gaggggaata

SEQ ID NO: 8796 - DNA, 10 bp, Saccharomyces cerevisiae
gaggggttcg

SEQ ID NO: 8797 - DNA, 10 bp, Saccharomyces cerevisiae
gagggtctcg

SEQ ID NO: 8798 - DNA, 10 bp, Saccharomyces cerevisiae
gagggtgggg

SEQ ID NO: 8799 - DNA, 10 bp, Saccharomyces cerevisiae
gagggtgggt

SEQ ID NO: 8800 - DNA, 10 bp, Saccharomyces cerevisiae
gaggtaaagt

SEQ ID NO: 8801 - DNA, 10 bp, Saccharomyces cerevisiae
gaggtagaca

SEQ ID NO: 8802 - DNA, 10 bp, Saccharomyces cerevisiae
gaggtagtga

SEQ ID NO: 8803 - DNA, 10 bp, Saccharomyces cerevisiae
gaggtgttta

SEQ ID NO: 8804 - DNA, 10 bp, Saccharomyces cerevisiae
gagtaaaaag

SEQ ID NO: 8805 - DNA, 10 bp, Saccharomyces cerevisiae
gagtaaactt

SEQ ID NO: 8806 - DNA, 10 bp, Saccharomyces cerevisiae
gagtacaata

SEQ ID NO: 8807 - DNA, 10 bp, Saccharomyces cerevisiae
gagtaccaac

SEQ ID NO: 8808 - DNA, 10 bp, Saccharomyces cerevisiae
gagtactctt

SEQ ID NO: 8809 - DNA, 10 bp, Saccharomyces cerevisiae
gagtaggccg

SEQ ID NO: 8810 - DNA, 10 bp, Saccharomyces cerevisiae
gagtataata

SEQ ID NO: 8811 - DNA, 10 bp, Saccharomyces cerevisiae
gagtcaatag

SEQ ID NO: 8812 - DNA, 10 bp, Saccharomyces cerevisiae
gagtcacaat

SEQ ID NO: 8813 - DNA, 10 bp, Saccharomyces cerevisiae
gagtcgctga

SEQ ID NO: 8814 - DNA, 10 bp, Saccharomyces cerevisiae
gagtctcttc

SEQ ID NO: 8815 - DNA, 10 bp, Saccharomyces cerevisiae
gagtgaaaaa

SEQ ID NO: 8816 - DNA, 10 bp, Saccharomyces cerevisiae
gagtgccaaa

SEQ ID NO: 8817 - DNA, 10 bp, Saccharomyces cerevisiae
gagtgggata

SEQ ID NO: 8818 - DNA, 10 bp, Saccharomyces cerevisiae
gagtgtccac

SEQ ID NO: 8819 - DNA, 10 bp, Saccharomyces cerevisiae
gagttatacc

SEQ ID NO: 8820 - DNA, 10 bp, Saccharomyces cerevisiae
gagttgcgcc

SEQ ID NO: 8821 - DNA, 10 bp, Saccharomyces cerevisiae
gagttggaat

SEQ ID NO: 8822 - DNA, 10 bp, Saccharomyces cerevisiae
gagtttatga

SEQ ID NO: 8823 - DNA, 10 bp, Saccharomyces cerevisiae
gataaaaaaa

SEQ ID NO: 8824 - DNA, 10 bp, Saccharomyces cerevisiae
gataaaatac

SEQ ID NO: 8825 - DNA, 10 bp, Saccharomyces cerevisiae
gataaagaac

SEQ ID NO: 8826 - DNA, 10 bp, Saccharomyces cerevisiae
gataaatacg

SEQ ID NO: 8827 - DNA, 10 bp, Saccharomyces cerevisiae
gataaatccc

SEQ ID NO: 8828 - DNA, 10 bp, Saccharomyces cerevisiae
gataacaaca

SEQ ID NO: 8829 - DNA, 10 bp, Saccharomyces cerevisiae
gataactatg

SEQ ID NO: 8830 - DNA, 10 bp, Saccharomyces cerevisiae
gataagattt

SEQ ID NO: 8831 - DNA, 10 bp, Saccharomyces cerevisiae
gataaggact

SEQ ID NO: 8832 - DNA, 10 bp, Saccharomyces cerevisiae
gataaggccc

SEQ ID NO: 8833 - DNA, 10 bp, Saccharomyces cerevisiae
gataaggcta

SEQ ID NO: 8834 - DNA, 10 bp, Saccharomyces cerevisiae
gataaggtta

SEQ ID NO: 8835 - DNA, 10 bp, Saccharomyces cerevisiae
gataatacca

SEQ ID NO: 8836 - DNA, 10 bp, Saccharomyces cerevisiae
gataatgaat

SEQ ID NO: 8837 - DNA, 10 bp, Saccharomyces cerevisiae
gataatgatg

SEQ ID NO: 8838 - DNA, 10 bp, Saccharomyces cerevisiae
gataattacc

SEQ ID NO: 8839 - DNA, 10 bp, Saccharomyces cerevisiae
gataattttg

SEQ ID NO: 8840 - DNA, 10 bp, Saccharomyces cerevisiae
gatacaaata

SEQ ID NO: 8841 - DNA, 10 bp, Saccharomyces cerevisiae
gatacaagac

SEQ ID NO: 8842 - DNA, 10 bp, Saccharomyces cerevisiae
gatacaaggt

SEQ ID NO: 8843 - DNA, 10 bp, Saccharomyces cerevisiae
gataccaatc

SEQ ID NO: 8844 - DNA, 10 bp, Saccharomyces cerevisiae
gatacctgga

SEQ ID NO: 8845 - DNA, 10 bp, Saccharomyces cerevisiae
gatacgacaa

SEQ ID NO: 8846 - DNA, 10 bp, Saccharomyces cerevisiae
gataggaaac

SEQ ID NO: 8847 - DNA, 10 bp, Saccharomyces cerevisiae
gataggacaa

SEQ ID NO: 8848 - DNA, 10 bp, Saccharomyces cerevisiae
gataggatta

SEQ ID NO: 8849 - DNA, 10 bp, Saccharomyces cerevisiae
gatagttaga

SEQ ID NO: 8850 - DNA, 10 bp, Saccharomyces cerevisiae
gatataaata

SEQ ID NO: 8851 - DNA, 10 bp, Saccharomyces cerevisiae
gatataatgg

SEQ ID NO: 8852 - DNA, 10 bp, Saccharomyces cerevisiae
gatatctcca

SEQ ID NO: 8853 - DNA, 10 bp, Saccharomyces cerevisiae
gatatgcata

SEQ ID NO: 8854 - DNA, 10 bp, Saccharomyces cerevisiae
gatatgcgtt

SEQ ID NO: 8855 - DNA, 10 bp, Saccharomyces cerevisiae
gatatggata

SEQ ID NO: 8856 - DNA, 10 bp, Saccharomyces cerevisiae
gatatggatg

SEQ ID NO: 8857 - DNA, 10 bp, Saccharomyces cerevisiae
gatatgtggg

SEQ ID NO: 8858 - DNA, 10 bp, Saccharomyces cerevisiae
gatatgttct

SEQ ID NO: 8859 - DNA, 10 bp, Saccharomyces cerevisiae
gatattaaaa

SEQ ID NO: 8860 - DNA, 10 bp, Saccharomyces cerevisiae
gatattacaa

SEQ ID NO: 8861 - DNA, 10 bp, Saccharomyces cerevisiae
gatattccag

SEQ ID NO: 8862 - DNA, 10 bp, Saccharomyces cerevisiae
gatatttccg

SEQ ID NO: 8863 - DNA, 10 bp, Saccharomyces cerevisiae
gatatttctt

SEQ ID NO: 8864 - DNA, 10 bp, Saccharomyces cerevisiae
gatcaacctc

SEQ ID NO: 8865 - DNA, 10 bp, Saccharomyces cerevisiae
gatcaacgag

SEQ ID NO: 8866 - DNA, 10 bp, Saccharomyces cerevisiae
gatcaaggta

SEQ ID NO: 8867 - DNA, 10 bp, Saccharomyces cerevisiae
gatcaagtta

SEQ ID NO: 8868 - DNA, 10 bp, Saccharomyces cerevisiae
gatcactggt

SEQ ID NO: 8869 - DNA, 10 bp, Saccharomyces cerevisiae
gatcagaagt

SEQ ID NO: 8870 - DNA, 10 bp, Saccharomyces cerevisiae
gatcagatta

SEQ ID NO: 8871 - DNA, 10 bp, Saccharomyces cerevisiae
gatcagttgg

SEQ ID NO: 8872 - DNA, 10 bp, Saccharomyces cerevisiae
gatcatctgg

SEQ ID NO: 8873 - DNA, 10 bp, Saccharomyces cerevisiae
gatccagtgg

SEQ ID NO: 8874 - DNA, 10 bp, Saccharomyces cerevisiae
gatcccgacg

SEQ ID NO: 8875 - DNA, 10 bp, Saccharomyces cerevisiae
gatccgtata

SEQ ID NO: 8876 - DNA, 10 bp, Saccharomyces cerevisiae
gatccttcgc

SEQ ID NO: 8877 - DNA, 10 bp, Saccharomyces cerevisiae
gatccttttg

SEQ ID NO: 8878 - DNA, 10 bp, Saccharomyces cerevisiae
gatcgagaaa

SEQ ID NO: 8879 - DNA, 10 bp, Saccharomyces cerevisiae
gatcgcatat

SEQ ID NO: 8880 - DNA, 10 bp, Saccharomyces cerevisiae
gatcgcccct

SEQ ID NO: 8881 - DNA, 10 bp, Saccharomyces cerevisiae
gatcgtacag

SEQ ID NO: 8882 - DNA, 10 bp, Saccharomyces cerevisiae
gatcgtgctt

SEQ ID NO: 8883 - DNA, 10 bp, Saccharomyces cerevisiae
gatcgtgtct

SEQ ID NO: 8884 - DNA, 10 bp, Saccharomyces cerevisiae
gatcgttgaa

SEQ ID NO: 8885 - DNA, 10 bp, Saccharomyces cerevisiae
gatcgttttc

SEQ ID NO: 8886 - DNA, 10 bp, Saccharomyces cerevisiae
gatctataaa

SEQ ID NO: 8887 - DNA, 10 bp, Saccharomyces cerevisiae
gatctcacca

SEQ ID NO: 8888 - DNA, 10 bp, Saccharomyces cerevisiae
gatctttaat

SEQ ID NO: 8889 - DNA, 10 bp, Saccharomyces cerevisiae
gatgaaaacg

SEQ ID NO: 8890 - DNA, 10 bp, Saccharomyces cerevisiae
gatgaaaaga

SEQ ID NO: 8891 - DNA, 10 bp, Saccharomyces cerevisiae
gatgaaatag

SEQ ID NO: 8892 - DNA, 10 bp, Saccharomyces cerevisiae
gatgaaattc

SEQ ID NO: 8893 - DNA, 10 bp, Saccharomyces cerevisiae
gatgaacagg

SEQ ID NO: 8894 - DNA, 10 bp, Saccharomyces cerevisiae
gatgaagaca

SEQ ID NO: 8895 - DNA, 10 bp, Saccharomyces cerevisiae
gatgaaggtt

SEQ ID NO: 8896 - DNA, 10 bp, Saccharomyces cerevisiae
gatgacactt

SEQ ID NO: 8897 - DNA, 10 bp, Saccharomyces cerevisiae
gatgacttgt

SEQ ID NO: 8898 - DNA, 10 bp, Saccharomyces cerevisiae
gatgagaaaa

SEQ ID NO: 8899 - DNA, 10 bp, Saccharomyces cerevisiae
gatgagactc

SEQ ID NO: 8900 - DNA, 10 bp, Saccharomyces cerevisiae
gatgagatcc

SEQ ID NO: 8901 - DNA, 10 bp, Saccharomyces cerevisiae
gatgagatta

SEQ ID NO: 8902 - DNA, 10 bp, Saccharomyces cerevisiae
gatgagcatt

SEQ ID NO: 8903 - DNA, 10 bp, Saccharomyces cerevisiae
gatgaggaaa

SEQ ID NO: 8904 - DNA, 10 bp, Saccharomyces cerevisiae
gatgagtttc

SEQ ID NO: 8905 - DNA, 10 bp, Saccharomyces cerevisiae
gatgatgaaa

SEQ ID NO: 8906 - DNA, 10 bp, Saccharomyces cerevisiae
gatgcaaaaa

SEQ ID NO: 8907 - DNA, 10 bp, Saccharomyces cerevisiae
gatgcaaagg

SEQ ID NO: 8908 - DNA, 10 bp, Saccharomyces cerevisiae
gatgcacacg

SEQ ID NO: 8909 - DNA, 10 bp, Saccharomyces cerevisiae
gatgcagcac

SEQ ID NO: 8910 - DNA, 10 bp, Saccharomyces cerevisiae
gatgccacaa

SEQ ID NO: 8911 - DNA, 10 bp, Saccharomyces cerevisiae
gatgccatca

SEQ ID NO: 8912 - DNA, 10 bp, Saccharomyces cerevisiae
gatgccccaa

SEQ ID NO: 8913 - DNA, 10 bp, Saccharomyces cerevisiae
gatgcgttaa

SEQ ID NO: 8914 - DNA, 10 bp, Saccharomyces cerevisiae
gatgctgatc

SEQ ID NO: 8915 - DNA, 10 bp, Saccharomyces cerevisiae
gatggaacaa

SEQ ID NO: 8916 - DNA, 10 bp, Saccharomyces cerevisiae
gatggaaggt

SEQ ID NO: 8917 - DNA, 10 bp, Saccharomyces cerevisiae
gatggagtta

SEQ ID NO: 8918 - DNA, 10 bp, Saccharomyces cerevisiae
gatggatgct

SEQ ID NO: 8919 - DNA, 10 bp, Saccharomyces cerevisiae
gatggcttct

SEQ ID NO: 8920 - DNA, 10 bp, Saccharomyces cerevisiae
gatgggctcc

SEQ ID NO: 8921 - DNA, 10 bp, Saccharomyces cerevisiae
gatggggtag

SEQ ID NO: 8922 - DNA, 10 bp, Saccharomyces cerevisiae
gatgggttgt

SEQ ID NO: 8923 - DNA, 10 bp, Saccharomyces cerevisiae
gatggtggat

SEQ ID NO: 8924 - DNA, 10 bp, Saccharomyces cerevisiae
gatggtttta

SEQ ID NO: 8925 - DNA, 10 bp, Saccharomyces cerevisiae
gatgtaatat

SEQ ID NO: 8926 - DNA, 10 bp, Saccharomyces cerevisiae
gatgtacaac

SEQ ID NO: 8927 - DNA, 10 bp, Saccharomyces cerevisiae
gatgtagaaa

SEQ ID NO: 8928 - DNA, 10 bp, Saccharomyces cerevisiae
gatgtatgaa

SEQ ID NO: 8929 - DNA, 10 bp, Saccharomyces cerevisiae
gatgtcaaac

SEQ ID NO: 8930 - DNA, 10 bp, Saccharomyces cerevisiae
gatgtcaacg

SEQ ID NO: 8931 - DNA, 10 bp, Saccharomyces cerevisiae
gatgtcacac

SEQ ID NO: 8932 - DNA, 10 bp, Saccharomyces cerevisiae
gatgtcagga

SEQ ID NO: 8933 - DNA, 10 bp, Saccharomyces cerevisiae
gatgtcatcc

SEQ ID NO: 8934 - DNA, 10 bp, Saccharomyces cerevisiae
gatgtgactg

SEQ ID NO: 8935 - DNA, 10 bp, Saccharomyces cerevisiae
gatgtgcaac

SEQ ID NO: 8936 - DNA, 10 bp, Saccharomyces cerevisiae
gatgttaacg

SEQ ID NO: 8937 - DNA, 10 bp, Saccharomyces cerevisiae
gatgttcttg

SEQ ID NO: 8938 - DNA, 10 bp, Saccharomyces cerevisiae
gatgttttgt

SEQ ID NO: 8939 - DNA, 10 bp, Saccharomyces cerevisiae
gattaacaaa

SEQ ID NO: 8940 - DNA, 10 bp, Saccharomyces cerevisiae
gattaagagg

SEQ ID NO: 8941 - DNA, 10 bp, Saccharomyces cerevisiae
gattaaggct

SEQ ID NO: 8942 - DNA, 10 bp, Saccharomyces cerevisiae
gattaccaga

SEQ ID NO: 8943 - DNA, 10 bp, Saccharomyces cerevisiae
gattactaag

SEQ ID NO: 8944 - DNA, 10 bp, Saccharomyces cerevisiae
gattactatc

SEQ ID NO: 8945 - DNA, 10 bp, Saccharomyces cerevisiae
gattatggat

SEQ ID NO: 8946 - DNA, 10 bp, Saccharomyces cerevisiae
gattatttgt

SEQ ID NO: 8947 - DNA, 10 bp, Saccharomyces cerevisiae
gattcaacgg

SEQ ID NO: 8948 - DNA, 10 bp, Saccharomyces cerevisiae
gattcacccc

SEQ ID NO: 8949 - DNA, 10 bp, Saccharomyces cerevisiae
gattccaaca

SEQ ID NO: 8950 - DNA, 10 bp, Saccharomyces cerevisiae
gattccattg

SEQ ID NO: 8951 - DNA, 10 bp, Saccharomyces cerevisiae
gattctcgaa

SEQ ID NO: 8952 - DNA, 10 bp, Saccharomyces cerevisiae
gattgaaaaa

SEQ ID NO: 8953 - DNA, 10 bp, Saccharomyces cerevisiae
gattgaaaat

SEQ ID NO: 8954 - DNA, 10 bp, Saccharomyces cerevisiae
gattgagcat

SEQ ID NO: 8955 - DNA, 10 bp, Saccharomyces cerevisiae
gattgcaaga

SEQ ID NO: 8956 - DNA, 10 bp, Saccharomyces cerevisiae
gattgcattg

SEQ ID NO: 8957 - DNA, 10 bp, Saccharomyces cerevisiae
gattgctgaa

SEQ ID NO: 8958 - DNA, 10 bp, Saccharomyces cerevisiae
gattgtagaa

SEQ ID NO: 8959 - DNA, 10 bp, Saccharomyces cerevisiae
gattgtcagt

SEQ ID NO: 8960 - DNA, 10 bp, Saccharomyces cerevisiae
gattgtccaa

SEQ ID NO: 8961 - DNA, 10 bp, Saccharomyces cerevisiae
gattgtctac

SEQ ID NO: 8962 - DNA, 10 bp, Saccharomyces cerevisiae
gattgtcttt

SEQ ID NO: 8963 - DNA, 10 bp, Saccharomyces cerevisiae
gattgtgaca

SEQ ID NO: 8964 - DNA, 10 bp, Saccharomyces cerevisiae
gattgttctg

SEQ ID NO: 8965 - DNA, 10 bp, Saccharomyces cerevisiae
gattgtttct

SEQ ID NO: 8966 - DNA, 10 bp, Saccharomyces cerevisiae
gatttaaaat

SEQ ID NO: 8967 - DNA, 10 bp, Saccharomyces cerevisiae
gatttaactc

SEQ ID NO: 8968 - DNA, 10 bp, Saccharomyces cerevisiae
gatttattgt

SEQ ID NO: 8969 - DNA, 10 bp, Saccharomyces cerevisiae
gatttcaaaa

SEQ ID NO: 8970 - DNA, 10 bp, Saccharomyces cerevisiae
gatttcagga

SEQ ID NO: 8971 - DNA, 10 bp, Saccharomyces cerevisiae
gatttcgtca

SEQ ID NO: 8972 - DNA, 10 bp, Saccharomyces cerevisiae
gatttctact

SEQ ID NO: 8973 - DNA, 10 bp, Saccharomyces cerevisiae
gatttcttgt

SEQ ID NO: 8974 - DNA, 10 bp, Saccharomyces cerevisiae
gatttggagc

SEQ ID NO: 8975 - DNA, 10 bp, Saccharomyces cerevisiae
gatttggcaa

SEQ ID NO: 8976 - DNA, 10 bp, Saccharomyces cerevisiae
gatttggctg

SEQ ID NO: 8977 - DNA, 10 bp, Saccharomyces cerevisiae
gatttggtta

SEQ ID NO: 8978 - DNA, 10 bp, Saccharomyces cerevisiae
gattttaaaa

SEQ ID NO: 8979 - DNA, 10 bp, Saccharomyces cerevisiae
gattttatca

SEQ ID NO: 8980 - DNA, 10 bp, Saccharomyces cerevisiae
gattttggtt

SEQ ID NO: 8981 - DNA, 10 bp, Saccharomyces cerevisiae
gatttttctt

SEQ ID NO: 8982 - DNA, 10 bp, Saccharomyces cerevisiae
gatttttgaa

SEQ ID NO: 8983 - DNA, 10 bp, Saccharomyces cerevisiae
gattttttat

SEQ ID NO: 8984 - DNA, 10 bp, Saccharomyces cerevisiae
gcaaaaaaaa

SEQ ID NO: 8985 - DNA, 10 bp, Saccharomyces cerevisiae
gcaaaaaatg

SEQ ID NO: 8986 - DNA, 10 bp, Saccharomyces cerevisiae
gcaaaacctt

SEQ ID NO: 8987 - DNA, 10 bp, Saccharomyces cerevisiae
gcaaaacttt

SEQ ID NO: 8988 - DNA, 10 bp, Saccharomyces cerevisiae
gcaaaatata

SEQ ID NO: 8989 - DNA, 10 bp, Saccharomyces cerevisiae
gcaaaatatt

SEQ ID NO: 8990 - DNA, 10 bp, Saccharomyces cerevisiae
gcaaaattag

SEQ ID NO: 8991 - DNA, 10 bp, Saccharomyces cerevisiae
gcaaaccaac

SEQ ID NO: 8992 - DNA, 10 bp, Saccharomyces cerevisiae
gcaaactact

SEQ ID NO: 8993 - DNA, 10 bp, Saccharomyces cerevisiae
gcaaagactt

SEQ ID NO: 8994 - DNA, 10 bp, Saccharomyces cerevisiae
gcaaaggata

SEQ ID NO: 8995 - DNA, 10 bp, Saccharomyces cerevisiae
gcaaaggcga

SEQ ID NO: 8996 - DNA, 10 bp, Saccharomyces cerevisiae
gcaaagttgg

SEQ ID NO: 8997 - DNA, 10 bp, Saccharomyces cerevisiae
gcaaataata

SEQ ID NO: 8998 - DNA, 10 bp, Saccharomyces cerevisiae
gcaaatggaa

SEQ ID NO: 8999 - DNA, 10 bp, Saccharomyces cerevisiae
gcaaatttgt

SEQ ID NO: 9000 - DNA, 10 bp, Saccharomyces cerevisiae
gcaaattttt

SEQ ID NO: 9001 - DNA, 10 bp, Saccharomyces cerevisiae
gcaacaagaa

SEQ ID NO: 9002 - DNA, 10 bp, Saccharomyces cerevisiae
gcaacacccg

SEQ ID NO: 9003 - DNA, 10 bp, Saccharomyces cerevisiae
gcaacacctt

SEQ ID NO: 9004 - DNA, 10 bp, Saccharomyces cerevisiae
gcaacagaag

SEQ ID NO: 9005 - DNA, 10 bp, Saccharomyces cerevisiae
gcaacaggag

SEQ ID NO: 9006 - DNA, 10 bp, Saccharomyces cerevisiae
gcaacattcg

SEQ ID NO: 9007 - DNA, 10 bp, Saccharomyces cerevisiae
gcaaccaatg

SEQ ID NO: 9008 - DNA, 10 bp, Saccharomyces cerevisiae
gcaaccaatt

SEQ ID NO: 9009 - DNA, 10 bp, Saccharomyces cerevisiae
gcaacccaat

SEQ ID NO: 9010 - DNA, 10 bp, Saccharomyces cerevisiae
gcaaccgggt

SEQ ID NO: 9011 - DNA, 10 bp, Saccharomyces cerevisiae
gcaactttac

SEQ ID NO: 9012 - DNA, 10 bp, Saccharomyces cerevisiae
gcaactttca

SEQ ID NO: 9013 - DNA, 10 bp, Saccharomyces cerevisiae
gcaagaaaga

SEQ ID NO: 9014 - DNA, 10 bp, Saccharomyces cerevisiae
gcaagaaggt

SEQ ID NO: 9015 - DNA, 10 bp, Saccharomyces cerevisiae
gcaagacatc

SEQ ID NO: 9016 - DNA, 10 bp, Saccharomyces cerevisiae
gcaagaccct

SEQ ID NO: 9017 - DNA, 10 bp, Saccharomyces cerevisiae
gcaagacctc

SEQ ID NO: 9018 - DNA, 10 bp, Saccharomyces cerevisiae
gcaagatctg

SEQ ID NO: 9019 - DNA, 10 bp, Saccharomyces cerevisiae
gcaagcaagc

SEQ ID NO: 9020 - DNA, 10 bp, Saccharomyces cerevisiae
gcaaggtatc

SEQ ID NO: 9021 - DNA, 10 bp, Saccharomyces cerevisiae
gcaaggtgtt

SEQ ID NO: 9022 - DNA, 10 bp, Saccharomyces cerevisiae
gcaagttctt

SEQ ID NO: 9023 - DNA, 10 bp, Saccharomyces cerevisiae
gcaataaaaa

SEQ ID NO: 9024 - DNA, 10 bp, Saccharomyces cerevisiae
gcaatactaa

SEQ ID NO: 9025 - DNA, 10 bp, Saccharomyces cerevisiae
gcaatagtac

SEQ ID NO: 9026 - DNA, 10 bp, Saccharomyces cerevisiae
gcaatatcac

SEQ ID NO: 9027 - DNA, 10 bp, Saccharomyces cerevisiae
gcaatattac

SEQ ID NO: 9028 - DNA, 10 bp, Saccharomyces cerevisiae
gcaatggcag

SEQ ID NO: 9029 - DNA, 10 bp, Saccharomyces cerevisiae
gcaatggcca

SEQ ID NO: 9030 - DNA, 10 bp, Saccharomyces cerevisiae
gcaattagac

SEQ ID NO: 9031 - DNA, 10 bp, Saccharomyces cerevisiae
gcaattggtt

SEQ ID NO: 9032 - DNA, 10 bp, Saccharomyces cerevisiae
gcacaatatt

SEQ ID NO: 9033 - DNA, 10 bp, Saccharomyces cerevisiae
gcacacttct

SEQ ID NO: 9034 - DNA, 10 bp, Saccharomyces cerevisiae
gcacaggtat

SEQ ID NO: 9035 - DNA, 10 bp, Saccharomyces cerevisiae
gcacatcagc

SEQ ID NO: 9036 - DNA, 10 bp, Saccharomyces cerevisiae
gcaccaatgg

SEQ ID NO: 9037 - DNA, 10 bp, Saccharomyces cerevisiae
gcaccatttt

SEQ ID NO: 9038 - DNA, 10 bp, Saccharomyces cerevisiae
gcaccccaac

SEQ ID NO: 9039 - DNA, 10 bp, Saccharomyces cerevisiae
gcacctgtta

SEQ ID NO: 9040 - DNA, 10 bp, Saccharomyces cerevisiae
gcacgcctat

SEQ ID NO: 9041 - DNA, 10 bp, Saccharomyces cerevisiae
gcacggtaac

SEQ ID NO: 9042 - DNA, 10 bp, Saccharomyces cerevisiae
gcacgtaagg

SEQ ID NO: 9043 - DNA, 10 bp, Saccharomyces cerevisiae
gcacgtgagg

SEQ ID NO: 9044 - DNA, 10 bp, Saccharomyces cerevisiae
gcacgtgcat

SEQ ID NO: 9045 - DNA, 10 bp, Saccharomyces cerevisiae
gcactctaat

SEQ ID NO: 9046 - DNA, 10 bp, Saccharomyces cerevisiae
gcactgaatc

SEQ ID NO: 9047 - DNA, 10 bp, Saccharomyces cerevisiae
gcactgagaa

SEQ ID NO: 9048 - DNA, 10 bp, Saccharomyces cerevisiae
gcactgagtc

SEQ ID NO: 9049 - DNA, 10 bp, Saccharomyces cerevisiae
gcactgatct

SEQ ID NO: 9050 - DNA, 10 bp, Saccharomyces cerevisiae
gcactgcata

SEQ ID NO: 9051 - DNA, 10 bp, Saccharomyces cerevisiae
gcactggagt

SEQ ID NO: 9052 - DNA, 10 bp, Saccharomyces cerevisiae
gcagaaacaa

SEQ ID NO: 9053 - DNA, 10 bp, Saccharomyces cerevisiae
gcagaaatta

SEQ ID NO: 9054 - DNA, 10 bp, Saccharomyces cerevisiae
gcagaacgcc

SEQ ID NO: 9055 - DNA, 10 bp, Saccharomyces cerevisiae
gcagaaggat

SEQ ID NO: 9056 - DNA, 10 bp, Saccharomyces cerevisiae
gcagaccgct

SEQ ID NO: 9057 - DNA, 10 bp, Saccharomyces cerevisiae
gcagacttgg

SEQ ID NO: 9058 - DNA, 10 bp, Saccharomyces cerevisiae
gcagagatga

SEQ ID NO: 9059 - DNA, 10 bp, Saccharomyces cerevisiae
gcagatgctt

SEQ ID NO: 9060 - DNA, 10 bp, Saccharomyces cerevisiae
gcagatttca

SEQ ID NO: 9061 - DNA, 10 bp, Saccharomyces cerevisiae
gcagcacaaa

SEQ ID NO: 9062 - DNA, 10 bp, Saccharomyces cerevisiae
gcagctacct

SEQ ID NO: 9063 - DNA, 10 bp, Saccharomyces cerevisiae
gcagctctgt

SEQ ID NO: 9064 - DNA, 10 bp, Saccharomyces cerevisiae
gcagctcttt

SEQ ID NO: 9065 - DNA, 10 bp, Saccharomyces cerevisiae
gcaggccagc

SEQ ID NO: 9066 - DNA, 10 bp, Saccharomyces cerevisiae
gcaggccagg

SEQ ID NO: 9067 - DNA, 10 bp, Saccharomyces cerevisiae
gcaggtgtgt

SEQ ID NO: 9068 - DNA, 10 bp, Saccharomyces cerevisiae
gcaggttggg

SEQ ID NO: 9069 - DNA, 10 bp, Saccharomyces cerevisiae
gcagtaaaag

SEQ ID NO: 9070 - DNA, 10 bp, Saccharomyces cerevisiae
gcagtagaga

SEQ ID NO: 9071 - DNA, 10 bp, Saccharomyces cerevisiae
gcagtcggat

SEQ ID NO: 9072 - DNA, 10 bp, Saccharomyces cerevisiae
gcagtgcaag

SEQ ID NO: 9073 - DNA, 10 bp, Saccharomyces cerevisiae
gcagtggtga

SEQ ID NO: 9074 - DNA, 10 bp, Saccharomyces cerevisiae
gcagttcaac

SEQ ID NO: 9075 - DNA, 10 bp, Saccharomyces cerevisiae
gcagttctca

SEQ ID NO: 9076 - DNA, 10 bp, Saccharomyces cerevisiae
gcataacttg

SEQ ID NO: 9077 - DNA, 10 bp, Saccharomyces cerevisiae
gcatactaac

SEQ ID NO: 9078 - DNA, 10 bp, Saccharomyces cerevisiae
gcataggagt

SEQ ID NO: 9079 - DNA, 10 bp, Saccharomyces cerevisiae
gcatatcata

SEQ ID NO: 9080 - DNA, 10 bp, Saccharomyces cerevisiae
gcatatgtgt

SEQ ID NO: 9081 - DNA, 10 bp, Saccharomyces cerevisiae
gcatatgttg

SEQ ID NO: 9082 - DNA, 10 bp, Saccharomyces cerevisiae
gcatattgta

SEQ ID NO: 9083 - DNA, 10 bp, Saccharomyces cerevisiae
gcatcatcgc

SEQ ID NO: 9084 - DNA, 10 bp, Saccharomyces cerevisiae
gcatccaacc

SEQ ID NO: 9085 - DNA, 10 bp, Saccharomyces cerevisiae
gcatcccgtg

SEQ ID NO: 9086 - DNA, 10 bp, Saccharomyces cerevisiae
gcatccgccc

SEQ ID NO: 9087 - DNA, 10 bp, Saccharomyces cerevisiae
gcatctagaa

SEQ ID NO: 9088 - DNA, 10 bp, Saccharomyces cerevisiae
gcatctccaa

SEQ ID NO: 9089 - DNA, 10 bp, Saccharomyces cerevisiae
gcatctgtat

SEQ ID NO: 9090 - DNA, 10 bp, Saccharomyces cerevisiae
gcatcttcat

SEQ ID NO: 9091 - DNA, 10 bp, Saccharomyces cerevisiae
gcatctttct

SEQ ID NO: 9092 - DNA, 10 bp, Saccharomyces cerevisiae
gcattacaaa

SEQ ID NO: 9093 - DNA, 10 bp, Saccharomyces cerevisiae
gcattactgg

SEQ ID NO: 9094 - DNA, 10 bp, Saccharomyces cerevisiae
gcattcctgg

SEQ ID NO: 9095 - DNA, 10 bp, Saccharomyces cerevisiae
gcattgaaaa

SEQ ID NO: 9096 - DNA, 10 bp, Saccharomyces cerevisiae
gcattggatg

SEQ ID NO: 9097 - DNA, 10 bp, Saccharomyces cerevisiae
gcattgtttg

SEQ ID NO: 9098 - DNA, 10 bp, Saccharomyces cerevisiae
gcatttggat

SEQ ID NO: 9099 - DNA, 10 bp, Saccharomyces cerevisiae
gcattttaca

SEQ ID NO: 9100 - DNA, 10 bp, Saccharomyces cerevisiae
gcattttcac

SEQ ID NO: 9101 - DNA, 10 bp, Saccharomyces cerevisiae
gcatttttcc

SEQ ID NO: 9102 - DNA, 10 bp, Saccharomyces cerevisiae
gccaaaccga

SEQ ID NO: 9103 - DNA, 10 bp, Saccharomyces cerevisiae
gccaagacct

SEQ ID NO: 9104 - DNA, 10 bp, Saccharomyces cerevisiae
gccaaggaca

SEQ ID NO: 9105 - DNA, 10 bp, Saccharomyces cerevisiae
gccaaggcct

SEQ ID NO: 9106 - DNA, 10 bp, Saccharomyces cerevisiae
gccaaggctt

SEQ ID NO: 9107 - DNA, 10 bp, Saccharomyces cerevisiae
gccaagggcc

SEQ ID NO: 9108 - DNA, 10 bp, Saccharomyces cerevisiae
gccaagggta

SEQ ID NO: 9109 - DNA, 10 bp, Saccharomyces cerevisiae
gccaatacta

SEQ ID NO: 9110 - DNA, 10 bp, Saccharomyces cerevisiae
gccaatcaaa

SEQ ID NO: 9111 - DNA, 10 bp, Saccharomyces cerevisiae
gccaatgcaa

SEQ ID NO: 9112 - DNA, 10 bp, Saccharomyces cerevisiae
gccaatgctg

SEQ ID NO: 9113 - DNA, 10 bp, Saccharomyces cerevisiae
gccaatggcc

SEQ ID NO: 9114 - DNA, 10 bp, Saccharomyces cerevisiae
gccaatgtca

SEQ ID NO: 9115 - DNA, 10 bp, Saccharomyces cerevisiae
gccaattaat

SEQ ID NO: 9116 - DNA, 10 bp, Saccharomyces cerevisiae
gccaattatt

SEQ ID NO: 9117 - DNA, 10 bp, Saccharomyces cerevisiae
gccacattct

SEQ ID NO: 9118 - DNA, 10 bp, Saccharomyces cerevisiae
gccacgacta

SEQ ID NO: 9119 - DNA, 10 bp, Saccharomyces cerevisiae
gccacgatgc

SEQ ID NO: 9120 - DNA, 10 bp, Saccharomyces cerevisiae
gccacggtcc

SEQ ID NO: 9121 - DNA, 10 bp, Saccharomyces cerevisiae
gccactagag

SEQ ID NO: 9122 - DNA, 10 bp, Saccharomyces cerevisiae
gccagatatg

SEQ ID NO: 9123 - DNA, 10 bp, Saccharomyces cerevisiae
gccagcacta

SEQ ID NO: 9124 - DNA, 10 bp, Saccharomyces cerevisiae
gccaggacaa

SEQ ID NO: 9125 - DNA, 10 bp, Saccharomyces cerevisiae
gccatactcg

SEQ ID NO: 9126 - DNA, 10 bp, Saccharomyces cerevisiae
gccatagtag

SEQ ID NO: 9127 - DNA, 10 bp, Saccharomyces cerevisiae
gccatatcca

SEQ ID NO: 9128 - DNA, 10 bp, Saccharomyces cerevisiae
gccattactt

SEQ ID NO: 9129 - DNA, 10 bp, Saccharomyces cerevisiae
gccattcttg

SEQ ID NO: 9130 - DNA, 10 bp, Saccharomyces cerevisiae
gccattgcgg

SEQ ID NO: 9131 - DNA, 10 bp, Saccharomyces cerevisiae
gccatttgct

SEQ ID NO: 9132 - DNA, 10 bp, Saccharomyces cerevisiae
gcccattact

SEQ ID NO: 9133 - DNA, 10 bp, Saccharomyces cerevisiae
gcccattttt

SEQ ID NO: 9134 - DNA, 10 bp, Saccharomyces cerevisiae
gccccagctc

SEQ ID NO: 9135 - DNA, 10 bp, Saccharomyces cerevisiae
gcccgcaaag

SEQ ID NO: 9136 - DNA, 10 bp, Saccharomyces cerevisiae
gcccggccgc

SEQ ID NO: 9137 - DNA, 10 bp, Saccharomyces cerevisiae
gccctccccc

SEQ ID NO: 9138 - DNA, 10 bp, Saccharomyces cerevisiae
gccctggcca

SEQ ID NO: 9139 - DNA, 10 bp, Saccharomyces cerevisiae
gccctgttgg

SEQ ID NO: 9140 - DNA, 10 bp, Saccharomyces cerevisiae
gcccttcctt

SEQ ID NO: 9141 - DNA, 10 bp, Saccharomyces cerevisiae
gccgaactca

SEQ ID NO: 9142 - DNA, 10 bp, Saccharomyces cerevisiae
gccgcacttg

SEQ ID NO: 9143 - DNA, 10 bp, Saccharomyces cerevisiae
gccgcataca

SEQ ID NO: 9144 - DNA, 10 bp, Saccharomyces cerevisiae
gccgccagac

SEQ ID NO: 9145 - DNA, 10 bp, Saccharomyces cerevisiae
gccgcgtgat

SEQ ID NO: 9146 - DNA, 10 bp, Saccharomyces cerevisiae
gccgctagac

SEQ ID NO: 9147 - DNA, 10 bp, Saccharomyces cerevisiae
gccgctagca

SEQ ID NO: 9148 - DNA, 10 bp, Saccharomyces cerevisiae
gccgctatgc

SEQ ID NO: 9149 - DNA, 10 bp, Saccharomyces cerevisiae
gccgctgcta

SEQ ID NO: 9150 - DNA, 10 bp, Saccharomyces cerevisiae
gccgcttcgt

SEQ ID NO: 9151 - DNA, 10 bp, Saccharomyces cerevisiae
gccggcagat

SEQ ID NO: 9152 - DNA, 10 bp, Saccharomyces cerevisiae
gccgggggta

SEQ ID NO: 9153 - DNA, 10 bp, Saccharomyces cerevisiae
gccggtgcgg

SEQ ID NO: 9154 - DNA, 10 bp, Saccharomyces cerevisiae
gccgtggagt

SEQ ID NO: 9155 - DNA, 10 bp, Saccharomyces cerevisiae
gccgttacag

SEQ ID NO: 9156 - DNA, 10 bp, Saccharomyces cerevisiae
gccgttagta

SEQ ID NO: 9157 - DNA, 10 bp, Saccharomyces cerevisiae
gcctaattta

SEQ ID NO: 9158 - DNA, 10 bp, Saccharomyces cerevisiae
gcctattcct

SEQ ID NO: 9159 - DNA, 10 bp, Saccharomyces cerevisiae
gcctcaaagg

SEQ ID NO: 9160 - DNA, 10 bp, Saccharomyces cerevisiae
gcctccccca

SEQ ID NO: 9161 - DNA, 10 bp, Saccharomyces cerevisiae
gcctcggggg

SEQ ID NO: 9162 - DNA, 10 bp, Saccharomyces cerevisiae
gcctcggtta

SEQ ID NO: 9163 - DNA, 10 bp, Saccharomyces cerevisiae
gcctctacgg

SEQ ID NO: 9164 - DNA, 10 bp, Saccharomyces cerevisiae
gcctctttct

SEQ ID NO: 9165 - DNA, 10 bp, Saccharomyces cerevisiae
gcctggatat

SEQ ID NO: 9166 - DNA, 10 bp, Saccharomyces cerevisiae
gcctggcgtg

SEQ ID NO: 9167 - DNA, 10 bp, Saccharomyces cerevisiae
gcctgtcttg

SEQ ID NO: 9168 - DNA, 10 bp, Saccharomyces cerevisiae
gcctgttgag

SEQ ID NO: 9169 - DNA, 10 bp, Saccharomyces cerevisiae
gccttaagtt

SEQ ID NO: 9170 - DNA, 10 bp, Saccharomyces cerevisiae
gccttagcgc

SEQ ID NO: 9171 - DNA, 10 bp, Saccharomyces cerevisiae
gccttcaact

SEQ ID NO: 9172 - DNA, 10 bp, Saccharomyces cerevisiae
gccttcaggc

SEQ ID NO: 9173 - DNA, 10 bp, Saccharomyces cerevisiae
gccttcatat

SEQ ID NO: 9174 - DNA, 10 bp, Saccharomyces cerevisiae
gccttccaca

SEQ ID NO: 9175 - DNA, 10 bp, Saccharomyces cerevisiae
gccttgacaa

SEQ ID NO: 9176 - DNA, 10 bp, Saccharomyces cerevisiae
gccttgatct

SEQ ID NO: 9177 - DNA, 10 bp, Saccharomyces cerevisiae
gccttgcaaa

SEQ ID NO: 9178 - DNA, 10 bp, Saccharomyces cerevisiae
gccttggata

SEQ ID NO: 9179 - DNA, 10 bp, Saccharomyces cerevisiae
gccttgtgaa

SEQ ID NO: 9180 - DNA, 10 bp, Saccharomyces cerevisiae
gcctttccca

SEQ ID NO: 9181 - DNA, 10 bp, Saccharomyces cerevisiae
gcctttgtgc

SEQ ID NO: 9182 - DNA, 10 bp, Saccharomyces cerevisiae
gcgaaatggc

SEQ ID NO: 9183 - DNA, 10 bp, Saccharomyces cerevisiae
gcgaaattcc

SEQ ID NO: 9184 - DNA, 10 bp, Saccharomyces cerevisiae
gcgaaatttt

SEQ ID NO: 9185 - DNA, 10 bp, Saccharomyces cerevisiae
gcgaaccact

SEQ ID NO: 9186 - DNA, 10 bp, Saccharomyces cerevisiae
gcgaagactg

SEQ ID NO: 9187 - DNA, 10 bp, Saccharomyces cerevisiae
gcgaagtaaa

SEQ ID NO: 9188 - DNA, 10 bp, Saccharomyces cerevisiae
gcgaataggt

SEQ ID NO: 9189 - DNA, 10 bp, Saccharomyces cerevisiae
gcgaattcca

SEQ ID NO: 9190 - DNA, 10 bp, Saccharomyces cerevisiae
gcgacataat

SEQ ID NO: 9191 - DNA, 10 bp, Saccharomyces cerevisiae
gcgacggaaa

SEQ ID NO: 9192 - DNA, 10 bp, Saccharomyces cerevisiae
gcgactattc

SEQ ID NO: 9193 - DNA, 10 bp, Saccharomyces cerevisiae
gcgagaggcc

SEQ ID NO: 9194 - DNA, 10 bp, Saccharomyces cerevisiae
gcgagcagat

SEQ ID NO: 9195 - DNA, 10 bp, Saccharomyces cerevisiae
gcgaggcaat

SEQ ID NO: 9196 - DNA, 10 bp, Saccharomyces cerevisiae
gcgagtaggc

SEQ ID NO: 9197 - DNA, 10 bp, Saccharomyces cerevisiae
gcgagttagt

SEQ ID NO: 9198 - DNA, 10 bp, Saccharomyces cerevisiae
gcgataccgg

SEQ ID NO: 9199 - DNA, 10 bp, Saccharomyces cerevisiae
gcgatccacg

SEQ ID NO: 9200 - DNA, 10 bp, Saccharomyces cerevisiae
gcgatggttt

SEQ ID NO: 9201 - DNA, 10 bp, Saccharomyces cerevisiae
gcgattattc

SEQ ID NO: 9202 - DNA, 10 bp, Saccharomyces cerevisiae
gcgattctgt

SEQ ID NO: 9203 - DNA, 10 bp, Saccharomyces cerevisiae
gcgattggct

SEQ ID NO: 9204 - DNA, 10 bp, Saccharomyces cerevisiae
gcgattgtgt

SEQ ID NO: 9205 - DNA, 10 bp, Saccharomyces cerevisiae
gcgcaagtac

SEQ ID NO: 9206 - DNA, 10 bp, Saccharomyces cerevisiae
gcgcaccaac

SEQ ID NO: 9207 - DNA, 10 bp, Saccharomyces cerevisiae
gcgcaccaca

SEQ ID NO: 9208 - DNA, 10 bp, Saccharomyces cerevisiae
gcgcaccaga

SEQ ID NO: 9209 - DNA, 10 bp, Saccharomyces cerevisiae
gcgcagatag

SEQ ID NO: 9210 - DNA, 10 bp, Saccharomyces cerevisiae
gcgcagttgg

SEQ ID NO: 9211 - DNA, 10 bp, Saccharomyces cerevisiae
gcgcatcaaa

SEQ ID NO: 9212 - DNA, 10 bp, Saccharomyces cerevisiae
gcgccaaata

SEQ ID NO: 9213 - DNA, 10 bp, Saccharomyces cerevisiae
gcgccagtct

SEQ ID NO: 9214 - DNA, 10 bp, Saccharomyces cerevisiae
gcgccatcgt

SEQ ID NO: 9215 - DNA, 10 bp, Saccharomyces cerevisiae
gcgccctagt

SEQ ID NO: 9216 - DNA, 10 bp, Saccharomyces cerevisiae
gcgccgagga

SEQ ID NO: 9217 - DNA, 10 bp, Saccharomyces cerevisiae
gcgccgccat

SEQ ID NO: 9218 - DNA, 10 bp, Saccharomyces cerevisiae
gcgccgtcca

SEQ ID NO: 9219 - DNA, 10 bp, Saccharomyces cerevisiae
gcgctaaggt

SEQ ID NO: 9220 - DNA, 10 bp, Saccharomyces cerevisiae
gcgctctcca

SEQ ID NO: 9221 - DNA, 10 bp, Saccharomyces cerevisiae
gcgcttcatt

SEQ ID NO: 9222 - DNA, 10 bp, Saccharomyces cerevisiae
gcggaagaat

SEQ ID NO: 9223 - DNA, 10 bp, Saccharomyces cerevisiae
gcggacaaaa

SEQ ID NO: 9224 - DNA, 10 bp, Saccharomyces cerevisiae
gcggagggca

SEQ ID NO: 9225 - DNA, 10 bp, Saccharomyces cerevisiae
gcggcagatc

SEQ ID NO: 9226 - DNA, 10 bp, Saccharomyces cerevisiae
gcggcgtcca

SEQ ID NO: 9227 - DNA, 10 bp, Saccharomyces cerevisiae
gcggctccag

SEQ ID NO: 9228 - DNA, 10 bp, Saccharomyces cerevisiae
gcgggcatat

SEQ ID NO: 9229 - DNA, 10 bp, Saccharomyces cerevisiae
gcgggcgtaa

SEQ ID NO: 9230 - DNA, 10 bp, Saccharomyces cerevisiae
gcgggtgctg

SEQ ID NO: 9231 - DNA, 10 bp, Saccharomyces cerevisiae
gcgggttctt

SEQ ID NO: 9232 - DNA, 10 bp, Saccharomyces cerevisiae
gcggtatttt

SEQ ID NO: 9233 - DNA, 10 bp, Saccharomyces cerevisiae
gcggtgcgtt

SEQ ID NO: 9234 - DNA, 10 bp, Saccharomyces cerevisiae
gcgtaccggg

SEQ ID NO: 9235 - DNA, 10 bp, Saccharomyces cerevisiae
gcgtactacc

SEQ ID NO: 9236 - DNA, 10 bp, Saccharomyces cerevisiae
gcgtataaaa

SEQ ID NO: 9237 - DNA, 10 bp, Saccharomyces cerevisiae
gcgtattcag

SEQ ID NO: 9238 - DNA, 10 bp, Saccharomyces cerevisiae
gcgtcaatgg

SEQ ID NO: 9239 - DNA, 10 bp, Saccharomyces cerevisiae
gcgtccccgc

SEQ ID NO: 9240 - DNA, 10 bp, Saccharomyces cerevisiae
gcgtcctttg

SEQ ID NO: 9241 - DNA, 10 bp, Saccharomyces cerevisiae
gcgtcgttgc

SEQ ID NO: 9242 - DNA, 10 bp, Saccharomyces cerevisiae
gcgtgaacgc

SEQ ID NO: 9243 - DNA, 10 bp, Saccharomyces cerevisiae
gcgtgaactt

SEQ ID NO: 9244 - DNA, 10 bp, Saccharomyces cerevisiae
gcgtgaagat

SEQ ID NO: 9245 - DNA, 10 bp, Saccharomyces cerevisiae
gcgtgattgt

SEQ ID NO: 9246 - DNA, 10 bp, Saccharomyces cerevisiae
gcgtgcgatg

SEQ ID NO: 9247 - DNA, 10 bp, Saccharomyces cerevisiae
gcgtggaagg

SEQ ID NO: 9248 - DNA, 10 bp, Saccharomyces cerevisiae
gcgtgtgctg

SEQ ID NO: 9249 - DNA, 10 bp, Saccharomyces cerevisiae
gcgtgtgggg

SEQ ID NO: 9250 - DNA, 10 bp, Saccharomyces cerevisiae
gcgtgtggta

SEQ ID NO: 9251 - DNA, 10 bp, Saccharomyces cerevisiae
gcgttactgt

SEQ ID NO: 9252 - DNA, 10 bp, Saccharomyces cerevisiae
gcgttattta

SEQ ID NO: 9253 - DNA, 10 bp, Saccharomyces cerevisiae
gcgttcaact

SEQ ID NO: 9254 - DNA, 10 bp, Saccharomyces cerevisiae
gcgttcatcc

SEQ ID NO: 9255 - DNA, 10 bp, Saccharomyces cerevisiae
gctaaaaatt

SEQ ID NO: 9256 - DNA, 10 bp, Saccharomyces cerevisiae
gctaaaacca

SEQ ID NO: 9257 - DNA, 10 bp, Saccharomyces cerevisiae
gctaaaattc

SEQ ID NO: 9258 - DNA, 10 bp, Saccharomyces cerevisiae
gctaaacaaa

SEQ ID NO: 9259 - DNA, 10 bp, Saccharomyces cerevisiae
gctaaatacc

SEQ ID NO: 9260 - DNA, 10 bp, Saccharomyces cerevisiae
gctaaattag

SEQ ID NO: 9261 - DNA, 10 bp, Saccharomyces cerevisiae
gctaactgtt

SEQ ID NO: 9262 - DNA, 10 bp, Saccharomyces cerevisiae
gctaagactt

SEQ ID NO: 9263 - DNA, 10 bp, Saccharomyces cerevisiae
gctaagtccg

SEQ ID NO: 9264 - DNA, 10 bp, Saccharomyces cerevisiae
gctacaaaac

SEQ ID NO: 9265 - DNA, 10 bp, Saccharomyces cerevisiae
gctacaagat

SEQ ID NO: 9266 - DNA, 10 bp, Saccharomyces cerevisiae
gctactggac

SEQ ID NO: 9267 - DNA, 10 bp, Saccharomyces cerevisiae
gctactggta

SEQ ID NO: 9268 - DNA, 10 bp, Saccharomyces cerevisiae
gctagaaaag

SEQ ID NO: 9269 - DNA, 10 bp, Saccharomyces cerevisiae
gctagacaac

SEQ ID NO: 9270 - DNA, 10 bp, Saccharomyces cerevisiae
gctagaccaa

SEQ ID NO: 9271 - DNA, 10 bp, Saccharomyces cerevisiae
gctagactaa

SEQ ID NO: 9272 - DNA, 10 bp, Saccharomyces cerevisiae
gctagcgaca

SEQ ID NO: 9273 - DNA, 10 bp, Saccharomyces cerevisiae
gctaggcttg

SEQ ID NO: 9274 - DNA, 10 bp, Saccharomyces cerevisiae
gctagtgtta

SEQ ID NO: 9275 - DNA, 10 bp, Saccharomyces cerevisiae
gctagtgttc

SEQ ID NO: 9276 - DNA, 10 bp, Saccharomyces cerevisiae
gctatagatc

SEQ ID NO: 9277 - DNA, 10 bp, Saccharomyces cerevisiae
gctatcaagg

SEQ ID NO: 9278 - DNA, 10 bp, Saccharomyces cerevisiae
gctatgtacc

SEQ ID NO: 9279 - DNA, 10 bp, Saccharomyces cerevisiae
gctatgtgca

SEQ ID NO: 9280 - DNA, 10 bp, Saccharomyces cerevisiae
gctcaaaaaa

SEQ ID NO: 9281 - DNA, 10 bp, Saccharomyces cerevisiae
gctcaaatat

SEQ ID NO: 9282 - DNA, 10 bp, Saccharomyces cerevisiae
gctcactggc

SEQ ID NO: 9283 - DNA, 10 bp, Saccharomyces cerevisiae
gctcagtaat

SEQ ID NO: 9284 - DNA, 10 bp, Saccharomyces cerevisiae
gctccattca

SEQ ID NO: 9285 - DNA, 10 bp, Saccharomyces cerevisiae
gctccccccc

SEQ ID NO: 9286 - DNA, 10 bp, Saccharomyces cerevisiae
gctcctgcag

SEQ ID NO: 9287 - DNA, 10 bp, Saccharomyces cerevisiae
gctccttgtg

SEQ ID NO: 9288 - DNA, 10 bp, Saccharomyces cerevisiae
gctcgcctgg

SEQ ID NO: 9289 - DNA, 10 bp, Saccharomyces cerevisiae
gctcggttaa

SEQ ID NO: 9290 - DNA, 10 bp, Saccharomyces cerevisiae
gctcgtgaac

SEQ ID NO: 9291 - DNA, 10 bp, Saccharomyces cerevisiae
gctctactgt

SEQ ID NO: 9292 - DNA, 10 bp, Saccharomyces cerevisiae
gctctcccca

SEQ ID NO: 9293 - DNA, 10 bp, Saccharomyces cerevisiae
gctctccctc

SEQ ID NO: 9294 - DNA, 10 bp, Saccharomyces cerevisiae
gctctgttga

SEQ ID NO: 9295 - DNA, 10 bp, Saccharomyces cerevisiae
gctcttacaa

SEQ ID NO: 9296 - DNA, 10 bp, Saccharomyces cerevisiae
gctcttagcg

SEQ ID NO: 9297 - DNA, 10 bp, Saccharomyces cerevisiae
gctcttatgg

SEQ ID NO: 9298 - DNA, 10 bp, Saccharomyces cerevisiae
gctctttcac

SEQ ID NO: 9299 - DNA, 10 bp, Saccharomyces cerevisiae
gctcttttct

SEQ ID NO: 9300 - DNA, 10 bp, Saccharomyces cerevisiae
gctgaaacgg

SEQ ID NO: 9301 - DNA, 10 bp, Saccharomyces cerevisiae
gctgaatata

SEQ ID NO: 9302 - DNA, 10 bp, Saccharomyces cerevisiae
gctgaatccc

SEQ ID NO: 9303 - DNA, 10 bp, Saccharomyces cerevisiae
gctgacgact

SEQ ID NO: 9304 - DNA, 10 bp, Saccharomyces cerevisiae
gctgagaaaa

SEQ ID NO: 9305 - DNA, 10 bp, Saccharomyces cerevisiae
gctgatgcaa

SEQ ID NO: 9306 - DNA, 10 bp, Saccharomyces cerevisiae
gctgatgcta

SEQ ID NO: 9307 - DNA, 10 bp, Saccharomyces cerevisiae
gctgcaaaaa

SEQ ID NO: 9308 - DNA, 10 bp, Saccharomyces cerevisiae
gctgcaatgg

SEQ ID NO: 9309 - DNA, 10 bp, Saccharomyces cerevisiae
gctgccagag

SEQ ID NO: 9310 - DNA, 10 bp, Saccharomyces cerevisiae
gctgccagat

SEQ ID NO: 9311 - DNA, 10 bp, Saccharomyces cerevisiae
gctgccgata

SEQ ID NO: 9312 - DNA, 10 bp, Saccharomyces cerevisiae
gctgctaaac

SEQ ID NO: 9313 - DNA, 10 bp, Saccharomyces cerevisiae
gctgctaacc

SEQ ID NO: 9314 - DNA, 10 bp, Saccharomyces cerevisiae
gctgctacgt

SEQ ID NO: 9315 - DNA, 10 bp, Saccharomyces cerevisiae
gctgctagcc

SEQ ID NO: 9316 - DNA, 10 bp, Saccharomyces cerevisiae
gctgctcaac

SEQ ID NO: 9317 - DNA, 10 bp, Saccharomyces cerevisiae
gctgctcact

SEQ ID NO: 9318 - DNA, 10 bp, Saccharomyces cerevisiae
gctgctccaa

SEQ ID NO: 9319 - DNA, 10 bp, Saccharomyces cerevisiae
gctgctcgaa

SEQ ID NO: 9320 - DNA, 10 bp, Saccharomyces cerevisiae
gctgctggcc

SEQ ID NO: 9321 - DNA, 10 bp, Saccharomyces cerevisiae
gctgcttgac

SEQ ID NO: 9322 - DNA, 10 bp, Saccharomyces cerevisiae
gctggatgca

SEQ ID NO: 9323 - DNA, 10 bp, Saccharomyces cerevisiae
gctggcaatc

SEQ ID NO: 9324 - DNA, 10 bp, Saccharomyces cerevisiae
gctggcggcg

SEQ ID NO: 9325 - DNA, 10 bp, Saccharomyces cerevisiae
gctggtaaga

SEQ ID NO: 9326 - DNA, 10 bp, Saccharomyces cerevisiae
gctggtatat

SEQ ID NO: 9327 - DNA, 10 bp, Saccharomyces cerevisiae
gctggtccta

SEQ ID NO: 9328 - DNA, 10 bp, Saccharomyces cerevisiae
gctggttaaa

SEQ ID NO: 9329 - DNA, 10 bp, Saccharomyces cerevisiae
gctgtcagcc

SEQ ID NO: 9330 - DNA, 10 bp, Saccharomyces cerevisiae
gctgtgaatt

SEQ ID NO: 9331 - DNA, 10 bp, Saccharomyces cerevisiae
gctgttatgc

SEQ ID NO: 9332 - DNA, 10 bp, Saccharomyces cerevisiae
gctgttggta

SEQ ID NO: 9333 - DNA, 10 bp, Saccharomyces cerevisiae
gctgtttctc

SEQ ID NO: 9334 - DNA, 10 bp, Saccharomyces cerevisiae
gcttaaaagc

SEQ ID NO: 9335 - DNA, 10 bp, Saccharomyces cerevisiae
gcttaactct

SEQ ID NO: 9336 - DNA, 10 bp, Saccharomyces cerevisiae
gcttaatcga

SEQ ID NO: 9337 - DNA, 10 bp, Saccharomyces cerevisiae
gcttaatctt

SEQ ID NO: 9338 - DNA, 10 bp, Saccharomyces cerevisiae
gcttaccatt

SEQ ID NO: 9339 - DNA, 10 bp, Saccharomyces cerevisiae
gcttaccttt

SEQ ID NO: 9340 - DNA, 10 bp, Saccharomyces cerevisiae
gcttactcaa

SEQ ID NO: 9341 - DNA, 10 bp, Saccharomyces cerevisiae
gcttagacat

SEQ ID NO: 9342 - DNA, 10 bp, Saccharomyces cerevisiae
gcttagggaa

SEQ ID NO: 9343 - DNA, 10 bp, Saccharomyces cerevisiae
gcttataaaa

SEQ ID NO: 9344 - DNA, 10 bp, Saccharomyces cerevisiae
gcttatgtaa

SEQ ID NO: 9345 - DNA, 10 bp, Saccharomyces cerevisiae
gcttcaagtt

SEQ ID NO: 9346 - DNA, 10 bp, Saccharomyces cerevisiae
gcttcaatgt

SEQ ID NO: 9347 - DNA, 10 bp, Saccharomyces cerevisiae
gcttcattaa

SEQ ID NO: 9348 - DNA, 10 bp, Saccharomyces cerevisiae
gcttccaata

SEQ ID NO: 9349 - DNA, 10 bp, Saccharomyces cerevisiae
gcttcgttta

SEQ ID NO: 9350 - DNA, 10 bp, Saccharomyces cerevisiae
gcttgaaaaa

SEQ ID NO: 9351 - DNA, 10 bp, Saccharomyces cerevisiae
gcttgagaat

SEQ ID NO: 9352 - DNA, 10 bp, Saccharomyces cerevisiae
gcttgctcct

SEQ ID NO: 9353 - DNA, 10 bp, Saccharomyces cerevisiae
gcttggcggg

SEQ ID NO: 9354 - DNA, 10 bp, Saccharomyces cerevisiae
gcttggtgca

SEQ ID NO: 9355 - DNA, 10 bp, Saccharomyces cerevisiae
gctttaacaa

SEQ ID NO: 9356 - DNA, 10 bp, Saccharomyces cerevisiae
gctttaaccc

SEQ ID NO: 9357 - DNA, 10 bp, Saccharomyces cerevisiae
gctttaaggt

SEQ ID NO: 9358 - DNA, 10 bp, Saccharomyces cerevisiae
gctttaccaa

SEQ ID NO: 9359 - DNA, 10 bp, Saccharomyces cerevisiae
gctttaggtt

SEQ ID NO: 9360 - DNA, 10 bp, Saccharomyces cerevisiae
gctttagtta

SEQ ID NO: 9361 - DNA, 10 bp, Saccharomyces cerevisiae
gctttcaaat

SEQ ID NO: 9362 - DNA, 10 bp, Saccharomyces cerevisiae
gctttccccc

SEQ ID NO: 9363 - DNA, 10 bp, Saccharomyces cerevisiae
gctttcccgc

SEQ ID NO: 9364 - DNA, 10 bp, Saccharomyces cerevisiae
gctttcttgt

SEQ ID NO: 9365 - DNA, 10 bp, Saccharomyces cerevisiae
gctttgaccg

SEQ ID NO: 9366 - DNA, 10 bp, Saccharomyces cerevisiae
gctttggaat

SEQ ID NO: 9367 - DNA, 10 bp, Saccharomyces cerevisiae
gctttggagg

SEQ ID NO: 9368 - DNA, 10 bp, Saccharomyces cerevisiae
gctttggcca

SEQ ID NO: 9369 - DNA, 10 bp, Saccharomyces cerevisiae
gcttttaaaa

SEQ ID NO: 9370 - DNA, 10 bp, Saccharomyces cerevisiae
gcttttatca

SEQ ID NO: 9371 - DNA, 10 bp, Saccharomyces cerevisiae
gcttttattc

SEQ ID NO: 9372 - DNA, 10 bp, Saccharomyces cerevisiae
gcttttggtc

SEQ ID NO: 9373 - DNA, 10 bp, Saccharomyces cerevisiae
gctttttgat

SEQ ID NO: 9374 - DNA, 10 bp, Saccharomyces cerevisiae
ggaaaaaagc

SEQ ID NO: 9375 - DNA, 10 bp, Saccharomyces cerevisiae
ggaaaaagtg

SEQ ID NO: 9376 - DNA, 10 bp, Saccharomyces cerevisiae
ggaaaaatgg

SEQ ID NO: 9377 - DNA, 10 bp, Saccharomyces cerevisiae
ggaaaaccag

SEQ ID NO: 9378 - DNA, 10 bp, Saccharomyces cerevisiae
ggaaaagacc

SEQ ID NO: 9379 - DNA, 10 bp, Saccharomyces cerevisiae
ggaaacactt

SEQ ID NO: 9380 - DNA, 10 bp, Saccharomyces cerevisiae
ggaaacagaa

SEQ ID NO: 9381 - DNA, 10 bp, Saccharomyces cerevisiae
ggaaagatgg

SEQ ID NO: 9382 - DNA, 10 bp, Saccharomyces cerevisiae
ggaaagcaag

SEQ ID NO: 9383 - DNA, 10 bp, Saccharomyces cerevisiae
ggaaagctct

SEQ ID NO: 9384 - DNA, 10 bp, Saccharomyces cerevisiae
ggaaagtaaa

SEQ ID NO: 9385 - DNA, 10 bp, Saccharomyces cerevisiae
ggaaatattt

SEQ ID NO: 9386 - DNA, 10 bp, Saccharomyces cerevisiae
ggaaatccga

SEQ ID NO: 9387 - DNA, 10 bp, Saccharomyces cerevisiae
ggaaatcttg

SEQ ID NO: 9388 - DNA, 10 bp, Saccharomyces cerevisiae
ggaaatgaat

SEQ ID NO: 9389 - DNA, 10 bp, Saccharomyces cerevisiae
ggaaatgtaa

SEQ ID NO: 9390 - DNA, 10 bp, Saccharomyces cerevisiae
ggaaattgtt

SEQ ID NO: 9391 - DNA, 10 bp, Saccharomyces cerevisiae
ggaacaccga

SEQ ID NO: 9392 - DNA, 10 bp, Saccharomyces cerevisiae
ggaaccatat

SEQ ID NO: 9393 - DNA, 10 bp, Saccharomyces cerevisiae
ggaactgaag

SEQ ID NO: 9394 - DNA, 10 bp, Saccharomyces cerevisiae
ggaactttga

SEQ ID NO: 9395 - DNA, 10 bp, Saccharomyces cerevisiae
ggaacttttc

SEQ ID NO: 9396 - DNA, 10 bp, Saccharomyces cerevisiae
ggaagaacga

SEQ ID NO: 9397 - DNA, 10 bp, Saccharomyces cerevisiae
ggaagagaag

SEQ ID NO: 9398 - DNA, 10 bp, Saccharomyces cerevisiae
ggaagagcta

SEQ ID NO: 9399 - DNA, 10 bp, Saccharomyces cerevisiae
ggaagagtat

SEQ ID NO: 9400 - DNA, 10 bp, Saccharomyces cerevisiae
ggaagattcg

SEQ ID NO: 9401 - DNA, 10 bp, Saccharomyces cerevisiae
ggaagctaac

SEQ ID NO: 9402 - DNA, 10 bp, Saccharomyces cerevisiae
ggaaggaaga

SEQ ID NO: 9403 - DNA, 10 bp, Saccharomyces cerevisiae
ggaaggttgg

SEQ ID NO: 9404 - DNA, 10 bp, Saccharomyces cerevisiae
ggaatactaa

SEQ ID NO: 9405 - DNA, 10 bp, Saccharomyces cerevisiae
ggaatatcat

SEQ ID NO: 9406 - DNA, 10 bp, Saccharomyces cerevisiae
ggaatccgga

SEQ ID NO: 9407 - DNA, 10 bp, Saccharomyces cerevisiae
ggaatgggag

SEQ ID NO: 9408 - DNA, 10 bp, Saccharomyces cerevisiae
ggaattaata

SEQ ID NO: 9409 - DNA, 10 bp, Saccharomyces cerevisiae
ggaattgtac

SEQ ID NO: 9410 - DNA, 10 bp, Saccharomyces cerevisiae
ggaatttagt

SEQ ID NO: 9411 - DNA, 10 bp, Saccharomyces cerevisiae
ggaatttcaa

SEQ ID NO: 9412 - DNA, 10 bp, Saccharomyces cerevisiae
ggacaacctg

SEQ ID NO: 9413 - DNA, 10 bp, Saccharomyces cerevisiae
ggacaactgg

SEQ ID NO: 9414 - DNA, 10 bp, Saccharomyces cerevisiae
ggacaactgt

SEQ ID NO: 9415 - DNA, 10 bp, Saccharomyces cerevisiae
ggacaagata

SEQ ID NO: 9416 - DNA, 10 bp, Saccharomyces cerevisiae
ggacacaaaa

SEQ ID NO: 9417 - DNA, 10 bp, Saccharomyces cerevisiae
ggacagcaga

SEQ ID NO: 9418 - DNA, 10 bp, Saccharomyces cerevisiae
ggacagctat

SEQ ID NO: 9419 - DNA, 10 bp, Saccharomyces cerevisiae
ggacataatg

SEQ ID NO: 9420 - DNA, 10 bp, Saccharomyces cerevisiae
ggacattatc

SEQ ID NO: 9421 - DNA, 10 bp, Saccharomyces cerevisiae
ggaccattgc

SEQ ID NO: 9422 - DNA, 10 bp, Saccharomyces cerevisiae
ggacccgccg

SEQ ID NO: 9423 - DNA, 10 bp, Saccharomyces cerevisiae
ggacctggca

SEQ ID NO: 9424 - DNA, 10 bp, Saccharomyces cerevisiae
ggaccttgcc

SEQ ID NO: 9425 - DNA, 10 bp, Saccharomyces cerevisiae
ggacctttga

SEQ ID NO: 9426 - DNA, 10 bp, Saccharomyces cerevisiae
ggacgtcatc

SEQ ID NO: 9427 - DNA, 10 bp, Saccharomyces cerevisiae
ggactgatga

SEQ ID NO: 9428 - DNA, 10 bp, Saccharomyces cerevisiae
ggactgccga

SEQ ID NO: 9429 - DNA, 10 bp, Saccharomyces cerevisiae
ggacttgaag

SEQ ID NO: 9430 - DNA, 10 bp, Saccharomyces cerevisiae
ggagaaaacg

SEQ ID NO: 9431 - DNA, 10 bp, Saccharomyces cerevisiae
ggagaaacaa

SEQ ID NO: 9432 - DNA, 10 bp, Saccharomyces cerevisiae
ggagaacatc

SEQ ID NO: 9433 - DNA, 10 bp, Saccharomyces cerevisiae
ggagaatcga

SEQ ID NO: 9434 - DNA, 10 bp, Saccharomyces cerevisiae
ggagacacag

SEQ ID NO: 9435 - DNA, 10 bp, Saccharomyces cerevisiae
ggagacccgt

SEQ ID NO: 9436 - DNA, 10 bp, Saccharomyces cerevisiae
ggagacgcca

SEQ ID NO: 9437 - DNA, 10 bp, Saccharomyces cerevisiae
ggagacgctg

SEQ ID NO: 9438 - DNA, 10 bp, Saccharomyces cerevisiae
ggagactggc

SEQ ID NO: 9439 - DNA, 10 bp, Saccharomyces cerevisiae
ggagacttgt

SEQ ID NO: 9440 - DNA, 10 bp, Saccharomyces cerevisiae
ggagaggaaa

SEQ ID NO: 9441 - DNA, 10 bp, Saccharomyces cerevisiae
ggagaggagt

SEQ ID NO: 9442 - DNA, 10 bp, Saccharomyces cerevisiae
ggagagtttc

SEQ ID NO: 9443 - DNA, 10 bp, Saccharomyces cerevisiae
ggagatacag

SEQ ID NO: 9444 - DNA, 10 bp, Saccharomyces cerevisiae
ggagattcaa

SEQ ID NO: 9445 - DNA, 10 bp, Saccharomyces cerevisiae
ggagctattt

SEQ ID NO: 9446 - DNA, 10 bp, Saccharomyces cerevisiae
ggagctccac

SEQ ID NO: 9447 - DNA, 10 bp, Saccharomyces cerevisiae
ggagcttggg

SEQ ID NO: 9448 - DNA, 10 bp, Saccharomyces cerevisiae
ggaggaatcg

SEQ ID NO: 9449 - DNA, 10 bp, Saccharomyces cerevisiae
ggaggatgaa

SEQ ID NO: 9450 - DNA, 10 bp, Saccharomyces cerevisiae
ggagggatgc

SEQ ID NO: 9451 - DNA, 10 bp, Saccharomyces cerevisiae
ggagggcaga

SEQ ID NO: 9452 - DNA, 10 bp, Saccharomyces cerevisiae
ggaggggtaa

SEQ ID NO: 9453 - DNA, 10 bp, Saccharomyces cerevisiae
ggaggtaaac

SEQ ID NO: 9454 - DNA, 10 bp, Saccharomyces cerevisiae
ggaggttgaa

SEQ ID NO: 9455 - DNA, 10 bp, Saccharomyces cerevisiae
ggaggtttca

SEQ ID NO: 9456 - DNA, 10 bp, Saccharomyces cerevisiae
ggagtagaca

SEQ ID NO: 9457 - DNA, 10 bp, Saccharomyces cerevisiae
ggagtatgaa

SEQ ID NO: 9458 - DNA, 10 bp, Saccharomyces cerevisiae
ggagtggaac

SEQ ID NO: 9459 - DNA, 10 bp, Saccharomyces cerevisiae
ggagttagaa

SEQ ID NO: 9460 - DNA, 10 bp, Saccharomyces cerevisiae
ggagtttagc

SEQ ID NO: 9461 - DNA, 10 bp, Saccharomyces cerevisiae
ggataaaaat

SEQ ID NO: 9462 - DNA, 10 bp, Saccharomyces cerevisiae
ggataaacaa

SEQ ID NO: 9463 - DNA, 10 bp, Saccharomyces cerevisiae
ggataattaa

SEQ ID NO: 9464 - DNA, 10 bp, Saccharomyces cerevisiae
ggatactaag

SEQ ID NO: 9465 - DNA, 10 bp, Saccharomyces cerevisiae
ggatagcggc

SEQ ID NO: 9466 - DNA, 10 bp, Saccharomyces cerevisiae
ggataggcgt

SEQ ID NO: 9467 - DNA, 10 bp, Saccharomyces cerevisiae
ggatattcta

SEQ ID NO: 9468 - DNA, 10 bp, Saccharomyces cerevisiae
ggatcagaag

SEQ ID NO: 9469 - DNA, 10 bp, Saccharomyces cerevisiae
ggatcggctt

SEQ ID NO: 9470 - DNA, 10 bp, Saccharomyces cerevisiae
ggatcgtccc

SEQ ID NO: 9471 - DNA, 10 bp, Saccharomyces cerevisiae
ggatcgttat

SEQ ID NO: 9472 - DNA, 10 bp, Saccharomyces cerevisiae
ggatgaaaaa

SEQ ID NO: 9473 - DNA, 10 bp, Saccharomyces cerevisiae
ggatgacgaa

SEQ ID NO: 9474 - DNA, 10 bp, Saccharomyces cerevisiae
ggatgatcgt

SEQ ID NO: 9475 - DNA, 10 bp, Saccharomyces cerevisiae
ggatgatgct

SEQ ID NO: 9476 - DNA, 10 bp, Saccharomyces cerevisiae
ggatgattga

SEQ ID NO: 9477 - DNA, 10 bp, Saccharomyces cerevisiae
ggatgcaatt

SEQ ID NO: 9478 - DNA, 10 bp, Saccharomyces cerevisiae
ggatgcataa

SEQ ID NO: 9479 - DNA, 10 bp, Saccharomyces cerevisiae
ggatgccaca

SEQ ID NO: 9480 - DNA, 10 bp, Saccharomyces cerevisiae
ggatgctgct

SEQ ID NO: 9481 - DNA, 10 bp, Saccharomyces cerevisiae
ggatggatct

SEQ ID NO: 9482 - DNA, 10 bp, Saccharomyces cerevisiae
ggatgttatt

SEQ ID NO: 9483 - DNA, 10 bp, Saccharomyces cerevisiae
ggatgttgaa

SEQ ID NO: 9484 - DNA, 10 bp, Saccharomyces cerevisiae
ggattaagtt

SEQ ID NO: 9485 - DNA, 10 bp, Saccharomyces cerevisiae
ggattcggtt

SEQ ID NO: 9486 - DNA, 10 bp, Saccharomyces cerevisiae
ggattgccca

SEQ ID NO: 9487 - DNA, 10 bp, Saccharomyces cerevisiae
ggattgtctc

SEQ ID NO: 9488 - DNA, 10 bp, Saccharomyces cerevisiae
ggattttgcc

SEQ ID NO: 9489 - DNA, 10 bp, Saccharomyces cerevisiae
ggattttgtt

SEQ ID NO: 9490 - DNA, 10 bp, Saccharomyces cerevisiae
ggcaaaatag

SEQ ID NO: 9491 - DNA, 10 bp, Saccharomyces cerevisiae
ggcaaactgt

SEQ ID NO: 9492 - DNA, 10 bp, Saccharomyces cerevisiae
ggcaaagaat

SEQ ID NO: 9493 - DNA, 10 bp, Saccharomyces cerevisiae
ggcaaattgc

SEQ ID NO: 9494 - DNA, 10 bp, Saccharomyces cerevisiae
ggcaacaatt

SEQ ID NO: 9495 - DNA, 10 bp, Saccharomyces cerevisiae
ggcaactggt

SEQ ID NO: 9496 - DNA, 10 bp, Saccharomyces cerevisiae
ggcaagaatc

SEQ ID NO: 9497 - DNA, 10 bp, Saccharomyces cerevisiae
ggcaagaccg

SEQ ID NO: 9498 - DNA, 10 bp, Saccharomyces cerevisiae
ggcaatacta

SEQ ID NO: 9499 - DNA, 10 bp, Saccharomyces cerevisiae
ggcacatcta

SEQ ID NO: 9500 - DNA, 10 bp, Saccharomyces cerevisiae
ggcaccgtaa

SEQ ID NO: 9501 - DNA, 10 bp, Saccharomyces cerevisiae
ggcactctga

SEQ ID NO: 9502 - DNA, 10 bp, Saccharomyces cerevisiae
ggcactggca

SEQ ID NO: 9503 - DNA, 10 bp, Saccharomyces cerevisiae
ggcacttgct

SEQ ID NO: 9504 - DNA, 10 bp, Saccharomyces cerevisiae
ggcagaaata

SEQ ID NO: 9505 - DNA, 10 bp, Saccharomyces cerevisiae
ggcagcaagg

SEQ ID NO: 9506 - DNA, 10 bp, Saccharomyces cerevisiae
ggcagcgtct

SEQ ID NO: 9507 - DNA, 10 bp, Saccharomyces cerevisiae
ggcagtatgt

SEQ ID NO: 9508 - DNA, 10 bp, Saccharomyces cerevisiae
ggcagttacg

SEQ ID NO: 9509 - DNA, 10 bp, Saccharomyces cerevisiae
ggcatcactt

SEQ ID NO: 9510 - DNA, 10 bp, Saccharomyces cerevisiae
ggcattgttc

SEQ ID NO: 9511 - DNA, 10 bp, Saccharomyces cerevisiae
ggccaactgt

SEQ ID NO: 9512 - DNA, 10 bp, Saccharomyces cerevisiae
ggccaaggtg

SEQ ID NO: 9513 - DNA, 10 bp, Saccharomyces cerevisiae
ggccaattta

SEQ ID NO: 9514 - DNA, 10 bp, Saccharomyces cerevisiae
ggccacggat

SEQ ID NO: 9515 - DNA, 10 bp, Saccharomyces cerevisiae
ggccatcttt

SEQ ID NO: 9516 - DNA, 10 bp, Saccharomyces cerevisiae
ggccattgct

SEQ ID NO: 9517 - DNA, 10 bp, Saccharomyces cerevisiae
ggccgcataa

SEQ ID NO: 9518 - DNA, 10 bp, Saccharomyces cerevisiae
ggcctacacc

SEQ ID NO: 9519 - DNA, 10 bp, Saccharomyces cerevisiae
ggcctcaaaa

SEQ ID NO: 9520 - DNA, 10 bp, Saccharomyces cerevisiae
ggccttataa

SEQ ID NO: 9521 - DNA, 10 bp, Saccharomyces cerevisiae
ggcgagattg

SEQ ID NO: 9522 - DNA, 10 bp, Saccharomyces cerevisiae
ggcgagctat

SEQ ID NO: 9523 - DNA, 10 bp, Saccharomyces cerevisiae
ggcgagtgct

SEQ ID NO: 9524 - DNA, 10 bp, Saccharomyces cerevisiae
ggcgatttcg

SEQ ID NO: 9525 - DNA, 10 bp, Saccharomyces cerevisiae
ggcgccaccg

SEQ ID NO: 9526 - DNA, 10 bp, Saccharomyces cerevisiae
ggcgccttat

SEQ ID NO: 9527 - DNA, 10 bp, Saccharomyces cerevisiae
ggcgctgtta

SEQ ID NO: 9528 - DNA, 10 bp, Saccharomyces cerevisiae
ggcggaataa

SEQ ID NO: 9529 - DNA, 10 bp, Saccharomyces cerevisiae
ggcggtgtta

SEQ ID NO: 9530 - DNA, 10 bp, Saccharomyces cerevisiae
ggcgtcatca

SEQ ID NO: 9531 - DNA, 10 bp, Saccharomyces cerevisiae
ggcgtcgttg

SEQ ID NO: 9532 - DNA, 10 bp, Saccharomyces cerevisiae
ggcgttgaaa

SEQ ID NO: 9533 - DNA, 10 bp, Saccharomyces cerevisiae
ggcgttttat

SEQ ID NO: 9534 - DNA, 10 bp, Saccharomyces cerevisiae
ggctagaaca

SEQ ID NO: 9535 - DNA, 10 bp, Saccharomyces cerevisiae
ggctcaaaaa

SEQ ID NO: 9536 - DNA, 10 bp, Saccharomyces cerevisiae
ggctccaagc

SEQ ID NO: 9537 - DNA, 10 bp, Saccharomyces cerevisiae
ggctccaatg

SEQ ID NO: 9538 - DNA, 10 bp, Saccharomyces cerevisiae
ggctcctaat

SEQ ID NO: 9539 - DNA, 10 bp, Saccharomyces cerevisiae
ggctcgaaag

SEQ ID NO: 9540 - DNA, 10 bp, Saccharomyces cerevisiae
ggctcgataa

SEQ ID NO: 9541 - DNA, 10 bp, Saccharomyces cerevisiae
ggctctaaaa

SEQ ID NO: 9542 - DNA, 10 bp, Saccharomyces cerevisiae
ggctgcctat

SEQ ID NO: 9543 - DNA, 10 bp, Saccharomyces cerevisiae
ggctgctcaa

SEQ ID NO: 9544 - DNA, 10 bp, Saccharomyces cerevisiae
ggctgggata

SEQ ID NO: 9545 - DNA, 10 bp, Saccharomyces cerevisiae
ggctgttcgt

SEQ ID NO: 9546 - DNA, 10 bp, Saccharomyces cerevisiae
ggcttcccag

SEQ ID NO: 9547 - DNA, 10 bp, Saccharomyces cerevisiae
ggcttcttct

SEQ ID NO: 9548 - DNA, 10 bp, Saccharomyces cerevisiae
ggcttgctaa

SEQ ID NO: 9549 - DNA, 10 bp, Saccharomyces cerevisiae
ggctttaagt

SEQ ID NO: 9550 - DNA, 10 bp, Saccharomyces cerevisiae
ggctttcctt

SEQ ID NO: 9551 - DNA, 10 bp, Saccharomyces cerevisiae
ggctttggtc

SEQ ID NO: 9552 - DNA, 10 bp, Saccharomyces cerevisiae
ggctttgtgt

SEQ ID NO: 9553 - DNA, 10 bp, Saccharomyces cerevisiae
ggcttttcaa

SEQ ID NO: 9554 - DNA, 10 bp, Saccharomyces cerevisiae
gggaaagctt

SEQ ID NO: 9555 - DNA, 10 bp, Saccharomyces cerevisiae
gggaaatcga

SEQ ID NO: 9556 - DNA, 10 bp, Saccharomyces cerevisiae
gggaaattgt

SEQ ID NO: 9557 - DNA, 10 bp, Saccharomyces cerevisiae
gggaaccatt

SEQ ID NO: 9558 - DNA, 10 bp, Saccharomyces cerevisiae
gggaacgtaa

SEQ ID NO: 9559 - DNA, 10 bp, Saccharomyces cerevisiae
gggaagactg

SEQ ID NO: 9560 - DNA, 10 bp, Saccharomyces cerevisiae
gggaagagtg

SEQ ID NO: 9561 - DNA, 10 bp, Saccharomyces cerevisiae
gggaagccca

SEQ ID NO: 9562 - DNA, 10 bp, Saccharomyces cerevisiae
gggaaggaaa

SEQ ID NO: 9563 - DNA, 10 bp, Saccharomyces cerevisiae
gggaaggata

SEQ ID NO: 9564 - DNA, 10 bp, Saccharomyces cerevisiae
gggaatctga

SEQ ID NO: 9565 - DNA, 10 bp, Saccharomyces cerevisiae
gggaattccg

SEQ ID NO: 9566 - DNA, 10 bp, Saccharomyces cerevisiae
gggacatata

SEQ ID NO: 9567 - DNA, 10 bp, Saccharomyces cerevisiae
gggaccctgt

SEQ ID NO: 9568 - DNA, 10 bp, Saccharomyces cerevisiae
gggaccttac

SEQ ID NO: 9569 - DNA, 10 bp, Saccharomyces cerevisiae
gggacgttga

SEQ ID NO: 9570 - DNA, 10 bp, Saccharomyces cerevisiae
gggagaaggt

SEQ ID NO: 9571 - DNA, 10 bp, Saccharomyces cerevisiae
gggagatctg

SEQ ID NO: 9572 - DNA, 10 bp, Saccharomyces cerevisiae
gggagatctt

SEQ ID NO: 9573 - DNA, 10 bp, Saccharomyces cerevisiae
gggagattca

SEQ ID NO: 9574 - DNA, 10 bp, Saccharomyces cerevisiae
gggagcagac

SEQ ID NO: 9575 - DNA, 10 bp, Saccharomyces cerevisiae
gggagcgggc

SEQ ID NO: 9576 - DNA, 10 bp, Saccharomyces cerevisiae
gggagtttat

SEQ ID NO: 9577 - DNA, 10 bp, Saccharomyces cerevisiae
gggatccttg

SEQ ID NO: 9578 - DNA, 10 bp, Saccharomyces cerevisiae
gggatctact

SEQ ID NO: 9579 - DNA, 10 bp, Saccharomyces cerevisiae
gggatcttga

SEQ ID NO: 9580 - DNA, 10 bp, Saccharomyces cerevisiae
gggatcttgc

SEQ ID NO: 9581 - DNA, 10 bp, Saccharomyces cerevisiae
gggatgacag

SEQ ID NO: 9582 - DNA, 10 bp, Saccharomyces cerevisiae
gggatgagca

SEQ ID NO: 9583 - DNA, 10 bp, Saccharomyces cerevisiae
gggatggatg

SEQ ID NO: 9584 - DNA, 10 bp, Saccharomyces cerevisiae
gggattaact

SEQ ID NO: 9585 - DNA, 10 bp, Saccharomyces cerevisiae
gggattagca

SEQ ID NO: 9586 - DNA, 10 bp, Saccharomyces cerevisiae
gggcaaactg

SEQ ID NO: 9587 - DNA, 10 bp, Saccharomyces cerevisiae
gggcaaatta

SEQ ID NO: 9588 - DNA, 10 bp, Saccharomyces cerevisiae
gggcaagttg

SEQ ID NO: 9589 - DNA, 10 bp, Saccharomyces cerevisiae
gggcaataga

SEQ ID NO: 9590 - DNA, 10 bp, Saccharomyces cerevisiae
gggcactcct

SEQ ID NO: 9591 - DNA, 10 bp, Saccharomyces cerevisiae
gggcatacta

SEQ ID NO: 9592 - DNA, 10 bp, Saccharomyces cerevisiae
gggcccaatg

SEQ ID NO: 9593 - DNA, 10 bp, Saccharomyces cerevisiae
gggcttacct

SEQ ID NO: 9594 - DNA, 10 bp, Saccharomyces cerevisiae
gggcttcttt

SEQ ID NO: 9595 - DNA, 10 bp, Saccharomyces cerevisiae
gggcttttgg

SEQ ID NO: 9596 - DNA, 10 bp, Saccharomyces cerevisiae
ggggaaaacg

SEQ ID NO: 9597 - DNA, 10 bp, Saccharomyces cerevisiae
ggggaaagta

SEQ ID NO: 9598 - DNA, 10 bp, Saccharomyces cerevisiae
ggggaaggtt

SEQ ID NO: 9599 - DNA, 10 bp, Saccharomyces cerevisiae
ggggagaatc

SEQ ID NO: 9600 - DNA, 10 bp, Saccharomyces cerevisiae
ggggagagca

SEQ ID NO: 9601 - DNA, 10 bp, Saccharomyces cerevisiae
ggggatttca

SEQ ID NO: 9602 - DNA, 10 bp, Saccharomyces cerevisiae
ggggcagaga

SEQ ID NO: 9603 - DNA, 10 bp, Saccharomyces cerevisiae
ggggcatccg

SEQ ID NO: 9604 - DNA, 10 bp, Saccharomyces cerevisiae
ggggccggtg

SEQ ID NO: 9605 - DNA, 10 bp, Saccharomyces cerevisiae
gggggagtgt

SEQ ID NO: 9606 - DNA, 10 bp, Saccharomyces cerevisiae
gggggcgggt

SEQ ID NO: 9607 - DNA, 10 bp, Saccharomyces cerevisiae
gggggctcta

SEQ ID NO: 9608 - DNA, 10 bp, Saccharomyces cerevisiae
gggggggcta

SEQ ID NO: 9609 - DNA, 10 bp, Saccharomyces cerevisiae
gggggtgcta

SEQ ID NO: 9610 - DNA, 10 bp, Saccharomyces cerevisiae
gggggtttcc

SEQ ID NO: 9611 - DNA, 10 bp, Saccharomyces cerevisiae
ggggtaaccg

SEQ ID NO: 9612 - DNA, 10 bp, Saccharomyces cerevisiae
ggggtatcta

SEQ ID NO: 9613 - DNA, 10 bp, Saccharomyces cerevisiae
ggggtcacaa

SEQ ID NO: 9614 - DNA, 10 bp, Saccharomyces cerevisiae
ggggtcgttg

SEQ ID NO: 9615 - DNA, 10 bp, Saccharomyces cerevisiae
ggggtggtta

SEQ ID NO: 9616 - DNA, 10 bp, Saccharomyces cerevisiae
ggggttcggt

SEQ ID NO: 9617 - DNA, 10 bp, Saccharomyces cerevisiae
ggggttcttg

SEQ ID NO: 9618 - DNA, 10 bp, Saccharomyces cerevisiae
gggtaagttc

SEQ ID NO: 9619 - DNA, 10 bp, Saccharomyces cerevisiae
gggtacaaag

SEQ ID NO: 9620 - DNA, 10 bp, Saccharomyces cerevisiae
gggtacattg

SEQ ID NO: 9621 - DNA, 10 bp, Saccharomyces cerevisiae
gggtacctgc

SEQ ID NO: 9622 - DNA, 10 bp, Saccharomyces cerevisiae
gggtactgaa

SEQ ID NO: 9623 - DNA, 10 bp, Saccharomyces cerevisiae
gggtactgat

SEQ ID NO: 9624 - DNA, 10 bp, Saccharomyces cerevisiae
gggtacttct

SEQ ID NO: 9625 - DNA, 10 bp, Saccharomyces cerevisiae
gggtactttg

SEQ ID NO: 9626 - DNA, 10 bp, Saccharomyces cerevisiae
gggtatacta

SEQ ID NO: 9627 - DNA, 10 bp, Saccharomyces cerevisiae
gggtattgaa

SEQ ID NO: 9628 - DNA, 10 bp, Saccharomyces cerevisiae
gggtccagct

SEQ ID NO: 9629 - DNA, 10 bp, Saccharomyces cerevisiae
gggtcggagg

SEQ ID NO: 9630 - DNA, 10 bp, Saccharomyces cerevisiae
gggtcgggtt

SEQ ID NO: 9631 - DNA, 10 bp, Saccharomyces cerevisiae
gggtgcagaa

SEQ ID NO: 9632 - DNA, 10 bp, Saccharomyces cerevisiae
gggtggatac

SEQ ID NO: 9633 - DNA, 10 bp, Saccharomyces cerevisiae
gggtggtgtc

SEQ ID NO: 9634 - DNA, 10 bp, Saccharomyces cerevisiae
gggtggttat

SEQ ID NO: 9635 - DNA, 10 bp, Saccharomyces cerevisiae
gggtgtaacg

SEQ ID NO: 9636 - DNA, 10 bp, Saccharomyces cerevisiae
gggtgtagtc

SEQ ID NO: 9637 - DNA, 10 bp, Saccharomyces cerevisiae
gggtgttggt

SEQ ID NO: 9638 - DNA, 10 bp, Saccharomyces cerevisiae
gggttaaaaa

SEQ ID NO: 9639 - DNA, 10 bp, Saccharomyces cerevisiae
gggttcggtg

SEQ ID NO: 9640 - DNA, 10 bp, Saccharomyces cerevisiae
gggttctccc

SEQ ID NO: 9641 - DNA, 10 bp, Saccharomyces cerevisiae
gggttctgaa

SEQ ID NO: 9642 - DNA, 10 bp, Saccharomyces cerevisiae
gggttgagaa

SEQ ID NO: 9643 - DNA, 10 bp, Saccharomyces cerevisiae
gggttgatgc

SEQ ID NO: 9644 - DNA, 10 bp, Saccharomyces cerevisiae
gggttgttca

SEQ ID NO: 9645 - DNA, 10 bp, Saccharomyces cerevisiae
gggttgtttg

SEQ ID NO: 9646 - DNA, 10 bp, Saccharomyces cerevisiae
gggtttctgg

SEQ ID NO: 9647 - DNA, 10 bp, Saccharomyces cerevisiae
gggtttgggt

SEQ ID NO: 9648 - DNA, 10 bp, Saccharomyces cerevisiae
gggtttggtt

SEQ ID NO: 9649 - DNA, 10 bp, Saccharomyces cerevisiae
gggttttaag

SEQ ID NO: 9650 - DNA, 10 bp, Saccharomyces cerevisiae
gggtttttga

SEQ ID NO: 9651 - DNA, 10 bp, Saccharomyces cerevisiae
ggtaaaacgt

SEQ ID NO: 9652 - DNA, 10 bp, Saccharomyces cerevisiae
ggtaaagatg

SEQ ID NO: 9653 - DNA, 10 bp, Saccharomyces cerevisiae
ggtaaattaa

SEQ ID NO: 9654 - DNA, 10 bp, Saccharomyces cerevisiae
ggtaaattag

SEQ ID NO: 9655 - DNA, 10 bp, Saccharomyces cerevisiae
ggtaaccgta

SEQ ID NO: 9656 - DNA, 10 bp, Saccharomyces cerevisiae
ggtaacgata

SEQ ID NO: 9657 - DNA, 10 bp, Saccharomyces cerevisiae
ggtaacggaa

SEQ ID NO: 9658 - DNA, 10 bp, Saccharomyces cerevisiae
ggtaacgttt

SEQ ID NO: 9659 - DNA, 10 bp, Saccharomyces cerevisiae
ggtaagatat

SEQ ID NO: 9660 - DNA, 10 bp, Saccharomyces cerevisiae
ggtaaggaca

SEQ ID NO: 9661 - DNA, 10 bp, Saccharomyces cerevisiae
ggtaaggtaa

SEQ ID NO: 9662 - DNA, 10 bp, Saccharomyces cerevisiae
ggtaatataa

SEQ ID NO: 9663 - DNA, 10 bp, Saccharomyces cerevisiae
ggtaatcgaa

SEQ ID NO: 9664 - DNA, 10 bp, Saccharomyces cerevisiae
ggtaatggcc

SEQ ID NO: 9665 - DNA, 10 bp, Saccharomyces cerevisiae
ggtaatgggc

SEQ ID NO: 9666 - DNA, 10 bp, Saccharomyces cerevisiae
ggtaatgtaa

SEQ ID NO: 9667 - DNA, 10 bp, Saccharomyces cerevisiae
ggtaattcaa

SEQ ID NO: 9668 - DNA, 10 bp, Saccharomyces cerevisiae
ggtacaaggg

SEQ ID NO: 9669 - DNA, 10 bp, Saccharomyces cerevisiae
ggtacaatga

SEQ ID NO: 9670 - DNA, 10 bp, Saccharomyces cerevisiae
ggtacagatg

SEQ ID NO: 9671 - DNA, 10 bp, Saccharomyces cerevisiae
ggtacagtgt

SEQ ID NO: 9672 - DNA, 10 bp, Saccharomyces cerevisiae
ggtaccaccg

SEQ ID NO: 9673 - DNA, 10 bp, Saccharomyces cerevisiae
ggtacctttg

SEQ ID NO: 9674 - DNA, 10 bp, Saccharomyces cerevisiae
ggtacgggtg

SEQ ID NO: 9675 - DNA, 10 bp, Saccharomyces cerevisiae
ggtacgtaaa

SEQ ID NO: 9676 - DNA, 10 bp, Saccharomyces cerevisiae
ggtactaaga

SEQ ID NO: 9677 - DNA, 10 bp, Saccharomyces cerevisiae
ggtactcgaa

SEQ ID NO: 9678 - DNA, 10 bp, Saccharomyces cerevisiae
ggtactctga

SEQ ID NO: 9679 - DNA, 10 bp, Saccharomyces cerevisiae
ggtactgacg

SEQ ID NO: 9680 - DNA, 10 bp, Saccharomyces cerevisiae
ggtactgagg

SEQ ID NO: 9681 - DNA, 10 bp, Saccharomyces cerevisiae
ggtacttaag

SEQ ID NO: 9682 - DNA, 10 bp, Saccharomyces cerevisiae
ggtactttgg

SEQ ID NO: 9683 - DNA, 10 bp, Saccharomyces cerevisiae
ggtagcgtaa

SEQ ID NO: 9684 - DNA, 10 bp, Saccharomyces cerevisiae
ggtagggtgg

SEQ ID NO: 9685 - DNA, 10 bp, Saccharomyces cerevisiae
ggtagtctta

SEQ ID NO: 9686 - DNA, 10 bp, Saccharomyces cerevisiae
ggtatattcg

SEQ ID NO: 9687 - DNA, 10 bp, Saccharomyces cerevisiae
ggtatcccgt

SEQ ID NO: 9688 - DNA, 10 bp, Saccharomyces cerevisiae
ggtatcgtaa

SEQ ID NO: 9689 - DNA, 10 bp, Saccharomyces cerevisiae
ggtatgactc

SEQ ID NO: 9690 - DNA, 10 bp, Saccharomyces cerevisiae
ggtattggct

SEQ ID NO: 9691 - DNA, 10 bp, Saccharomyces cerevisiae
ggtcaaatca

SEQ ID NO: 9692 - DNA, 10 bp, Saccharomyces cerevisiae
ggtcaagggc

SEQ ID NO: 9693 - DNA, 10 bp, Saccharomyces cerevisiae
ggtcaatggg

SEQ ID NO: 9694 - DNA, 10 bp, Saccharomyces cerevisiae
ggtcacatct

SEQ ID NO: 9695 - DNA, 10 bp, Saccharomyces cerevisiae
ggtcagattg

SEQ ID NO: 9696 - DNA, 10 bp, Saccharomyces cerevisiae
ggtccaactt

SEQ ID NO: 9697 - DNA, 10 bp, Saccharomyces cerevisiae
ggtccacttc

SEQ ID NO: 9698 - DNA, 10 bp, Saccharomyces cerevisiae
ggtccagcta

SEQ ID NO: 9699 - DNA, 10 bp, Saccharomyces cerevisiae
ggtccagctg

SEQ ID NO: 9700 - DNA, 10 bp, Saccharomyces cerevisiae
ggtccagttt

SEQ ID NO: 9701 - DNA, 10 bp, Saccharomyces cerevisiae
ggtccccgtt

SEQ ID NO: 9702 - DNA, 10 bp, Saccharomyces cerevisiae
ggtcccgctt

SEQ ID NO: 9703 - DNA, 10 bp, Saccharomyces cerevisiae
ggtcccgtaa

SEQ ID NO: 9704 - DNA, 10 bp, Saccharomyces cerevisiae
ggtcccttca

SEQ ID NO: 9705 - DNA, 10 bp, Saccharomyces cerevisiae
ggtccgcctt

SEQ ID NO: 9706 - DNA, 10 bp, Saccharomyces cerevisiae
ggtccgtcaa

SEQ ID NO: 9707 - DNA, 10 bp, Saccharomyces cerevisiae
ggtcctgctt

SEQ ID NO: 9708 - DNA, 10 bp, Saccharomyces cerevisiae
ggtcgcttaa

SEQ ID NO: 9709 - DNA, 10 bp, Saccharomyces cerevisiae
ggtcggtagt

SEQ ID NO: 9710 - DNA, 10 bp, Saccharomyces cerevisiae
ggtcggtgat

SEQ ID NO: 9711 - DNA, 10 bp, Saccharomyces cerevisiae
ggtctcatta

SEQ ID NO: 9712 - DNA, 10 bp, Saccharomyces cerevisiae
ggtctcccac

SEQ ID NO: 9713 - DNA, 10 bp, Saccharomyces cerevisiae
ggtctgatga

SEQ ID NO: 9714 - DNA, 10 bp, Saccharomyces cerevisiae
ggtctgtctc

SEQ ID NO: 9715 - DNA, 10 bp, Saccharomyces cerevisiae
ggtcttcatt

SEQ ID NO: 9716 - DNA, 10 bp, Saccharomyces cerevisiae
ggtcttggtt

SEQ ID NO: 9717 - DNA, 10 bp, Saccharomyces cerevisiae
ggtgaaaact

SEQ ID NO: 9718 - DNA, 10 bp, Saccharomyces cerevisiae
ggtgaaaagg

SEQ ID NO: 9719 - DNA, 10 bp, Saccharomyces cerevisiae
ggtgaaaagt

SEQ ID NO: 9720 - DNA, 10 bp, Saccharomyces cerevisiae
ggtgaaacgg

SEQ ID NO: 9721 - DNA, 10 bp, Saccharomyces cerevisiae
ggtgaaactt

SEQ ID NO: 9722 - DNA, 10 bp, Saccharomyces cerevisiae
ggtgaaggtt

SEQ ID NO: 9723 - DNA, 10 bp, Saccharomyces cerevisiae
ggtgacaacg

SEQ ID NO: 9724 - DNA, 10 bp, Saccharomyces cerevisiae
ggtgacctac

SEQ ID NO: 9725 - DNA, 10 bp, Saccharomyces cerevisiae
ggtgacgagg

SEQ ID NO: 9726 - DNA, 10 bp, Saccharomyces cerevisiae
ggtgagaacg

SEQ ID NO: 9727 - DNA, 10 bp, Saccharomyces cerevisiae
ggtgatgctg

SEQ ID NO: 9728 - DNA, 10 bp, Saccharomyces cerevisiae
ggtgatttga

SEQ ID NO: 9729 - DNA, 10 bp, Saccharomyces cerevisiae
ggtgcaagat

SEQ ID NO: 9730 - DNA, 10 bp, Saccharomyces cerevisiae
ggtgccaaag

SEQ ID NO: 9731 - DNA, 10 bp, Saccharomyces cerevisiae
ggtgccaaga

SEQ ID NO: 9732 - DNA, 10 bp, Saccharomyces cerevisiae
ggtgccagtc

SEQ ID NO: 9733 - DNA, 10 bp, Saccharomyces cerevisiae
ggtgccgtcc

SEQ ID NO: 9734 - DNA, 10 bp, Saccharomyces cerevisiae
ggtgcgaaga

SEQ ID NO: 9735 - DNA, 10 bp, Saccharomyces cerevisiae
ggtgctaaag

SEQ ID NO: 9736 - DNA, 10 bp, Saccharomyces cerevisiae
ggtgctaaat

SEQ ID NO: 9737 - DNA, 10 bp, Saccharomyces cerevisiae
ggtgctaggt

SEQ ID NO: 9738 - DNA, 10 bp, Saccharomyces cerevisiae
ggtgctatga

SEQ ID NO: 9739 - DNA, 10 bp, Saccharomyces cerevisiae
ggtgctgagg

SEQ ID NO: 9740 - DNA, 10 bp, Saccharomyces cerevisiae
ggtgctgata

SEQ ID NO: 9741 - DNA, 10 bp, Saccharomyces cerevisiae
ggtgctggag

SEQ ID NO: 9742 - DNA, 10 bp, Saccharomyces cerevisiae
ggtgctgttg

SEQ ID NO: 9743 - DNA, 10 bp, Saccharomyces cerevisiae
ggtgcttaag

SEQ ID NO: 9744 - DNA, 10 bp, Saccharomyces cerevisiae
ggtggaatta

SEQ ID NO: 9745 - DNA, 10 bp, Saccharomyces cerevisiae
ggtggcgggg

SEQ ID NO: 9746 - DNA, 10 bp, Saccharomyces cerevisiae
ggtggcggtt

SEQ ID NO: 9747 - DNA, 10 bp, Saccharomyces cerevisiae
ggtgggtaca

SEQ ID NO: 9748 - DNA, 10 bp, Saccharomyces cerevisiae
ggtggtaaac

SEQ ID NO: 9749 - DNA, 10 bp, Saccharomyces cerevisiae
ggtggtatat

SEQ ID NO: 9750 - DNA, 10 bp, Saccharomyces cerevisiae
ggtggtatgt

SEQ ID NO: 9751 - DNA, 10 bp, Saccharomyces cerevisiae
ggtggttaac

SEQ ID NO: 9752 - DNA, 10 bp, Saccharomyces cerevisiae
ggtgtaacgg

SEQ ID NO: 9753 - DNA, 10 bp, Saccharomyces cerevisiae
ggtgtcggct

SEQ ID NO: 9754 - DNA, 10 bp, Saccharomyces cerevisiae
ggtgtcgtcg

SEQ ID NO: 9755 - DNA, 10 bp, Saccharomyces cerevisiae
ggtgtcgtgc

SEQ ID NO: 9756 - DNA, 10 bp, Saccharomyces cerevisiae
ggtgtcgtgg

SEQ ID NO: 9757 - DNA, 10 bp, Saccharomyces cerevisiae
ggtgtcttgc

SEQ ID NO: 9758 - DNA, 10 bp, Saccharomyces cerevisiae
ggtgtgacga

SEQ ID NO: 9759 - DNA, 10 bp, Saccharomyces cerevisiae
ggtgtgcgta

SEQ ID NO: 9760 - DNA, 10 bp, Saccharomyces cerevisiae
ggtgtggagg

SEQ ID NO: 9761 - DNA, 10 bp, Saccharomyces cerevisiae
ggtgtgttac

SEQ ID NO: 9762 - DNA, 10 bp, Saccharomyces cerevisiae
ggtgttaaga

SEQ ID NO: 9763 - DNA, 10 bp, Saccharomyces cerevisiae
ggtgttaagg

SEQ ID NO: 9764 - DNA, 10 bp, Saccharomyces cerevisiae
ggtgttaagt

SEQ ID NO: 9765 - DNA, 10 bp, Saccharomyces cerevisiae
ggtgttacgg

SEQ ID NO: 9766 - DNA, 10 bp, Saccharomyces cerevisiae
ggtgttatcg

SEQ ID NO: 9767 - DNA, 10 bp, Saccharomyces cerevisiae
ggtgttgacg

SEQ ID NO: 9768 - DNA, 10 bp, Saccharomyces cerevisiae
ggtgttgttg

SEQ ID NO: 9769 - DNA, 10 bp, Saccharomyces cerevisiae
ggttaaattt

SEQ ID NO: 9770 - DNA, 10 bp, Saccharomyces cerevisiae
ggttaacaaa

SEQ ID NO: 9771 - DNA, 10 bp, Saccharomyces cerevisiae
ggttaatgcg

SEQ ID NO: 9772 - DNA, 10 bp, Saccharomyces cerevisiae
ggttagatag

SEQ ID NO: 9773 - DNA, 10 bp, Saccharomyces cerevisiae
ggttaggcct

SEQ ID NO: 9774 - DNA, 10 bp, Saccharomyces cerevisiae
ggttagtttc

SEQ ID NO: 9775 - DNA, 10 bp, Saccharomyces cerevisiae
ggttattcct

SEQ ID NO: 9776 - DNA, 10 bp, Saccharomyces cerevisiae
ggttcaagaa

SEQ ID NO: 9777 - DNA, 10 bp, Saccharomyces cerevisiae
ggttcatcat

SEQ ID NO: 9778 - DNA, 10 bp, Saccharomyces cerevisiae
ggttccaacg

SEQ ID NO: 9779 - DNA, 10 bp, Saccharomyces cerevisiae
ggttcgggtt

SEQ ID NO: 9780 - DNA, 10 bp, Saccharomyces cerevisiae
ggttctgttc

SEQ ID NO: 9781 - DNA, 10 bp, Saccharomyces cerevisiae
ggttctttag

SEQ ID NO: 9782 - DNA, 10 bp, Saccharomyces cerevisiae
ggttgacacc

SEQ ID NO: 9783 - DNA, 10 bp, Saccharomyces cerevisiae
ggttgcagat

SEQ ID NO: 9784 - DNA, 10 bp, Saccharomyces cerevisiae
ggttgccaga

SEQ ID NO: 9785 - DNA, 10 bp, Saccharomyces cerevisiae
ggttgcccgc

SEQ ID NO: 9786 - DNA, 10 bp, Saccharomyces cerevisiae
ggttgccctc

SEQ ID NO: 9787 - DNA, 10 bp, Saccharomyces cerevisiae
ggttgctgtc

SEQ ID NO: 9788 - DNA, 10 bp, Saccharomyces cerevisiae
ggttgcttta

SEQ ID NO: 9789 - DNA, 10 bp, Saccharomyces cerevisiae
ggttggactt

SEQ ID NO: 9790 - DNA, 10 bp, Saccharomyces cerevisiae
ggttggatgc

SEQ ID NO: 9791 - DNA, 10 bp, Saccharomyces cerevisiae
ggttggtctg

SEQ ID NO: 9792 - DNA, 10 bp, Saccharomyces cerevisiae
ggttgttaac

SEQ ID NO: 9793 - DNA, 10 bp, Saccharomyces cerevisiae
ggtttaaact

SEQ ID NO: 9794 - DNA, 10 bp, Saccharomyces cerevisiae
ggtttaatta

SEQ ID NO: 9795 - DNA, 10 bp, Saccharomyces cerevisiae
ggtttcagtt

SEQ ID NO: 9796 - DNA, 10 bp, Saccharomyces cerevisiae
ggtttcccca

SEQ ID NO: 9797 - DNA, 10 bp, Saccharomyces cerevisiae
ggtttcgatt

SEQ ID NO: 9798 - DNA, 10 bp, Saccharomyces cerevisiae
ggtttcgctt

SEQ ID NO: 9799 - DNA, 10 bp, Saccharomyces cerevisiae
ggtttcggct

SEQ ID NO: 9800 - DNA, 10 bp, Saccharomyces cerevisiae
ggtttcgggg

SEQ ID NO: 9801 - DNA, 10 bp, Saccharomyces cerevisiae
ggtttctgaa

SEQ ID NO: 9802 - DNA, 10 bp, Saccharomyces cerevisiae
ggtttctgcg

SEQ ID NO: 9803 - DNA, 10 bp, Saccharomyces cerevisiae
ggtttctgtt

SEQ ID NO: 9804 - DNA, 10 bp, Saccharomyces cerevisiae
ggtttgttta

SEQ ID NO: 9805 - DNA, 10 bp, Saccharomyces cerevisiae
ggttttaacg

SEQ ID NO: 9806 - DNA, 10 bp, Saccharomyces cerevisiae
ggttttaatg

SEQ ID NO: 9807 - DNA, 10 bp, Saccharomyces cerevisiae
ggttttactt

SEQ ID NO: 9808 - DNA, 10 bp, Saccharomyces cerevisiae
ggttttcttt

SEQ ID NO: 9809 - DNA, 10 bp, Saccharomyces cerevisiae
ggttttggag

SEQ ID NO: 9810 - DNA, 10 bp, Saccharomyces cerevisiae
ggttttggat

SEQ ID NO: 9811 - DNA, 10 bp, Saccharomyces cerevisiae
ggttttggca

SEQ ID NO: 9812 - DNA, 10 bp, Saccharomyces cerevisiae
ggttttgggt

SEQ ID NO: 9813 - DNA, 10 bp, Saccharomyces cerevisiae
ggtttttgac

SEQ ID NO: 9814 - DNA, 10 bp, Saccharomyces cerevisiae
ggtttttggt

SEQ ID NO: 9815 - DNA, 10 bp, Saccharomyces cerevisiae
gtaaaaaaga

SEQ ID NO: 9816 - DNA, 10 bp, Saccharomyces cerevisiae
gtaaaaatag

SEQ ID NO: 9817 - DNA, 10 bp, Saccharomyces cerevisiae
gtaaaacagc

SEQ ID NO: 9818 - DNA, 10 bp, Saccharomyces cerevisiae
gtaaaattac

SEQ ID NO: 9819 - DNA, 10 bp, Saccharomyces cerevisiae
gtaaaccttg

SEQ ID NO: 9820 - DNA, 10 bp, Saccharomyces cerevisiae
gtaaacttta

SEQ ID NO: 9821 - DNA, 10 bp, Saccharomyces cerevisiae
gtaaagatcc

SEQ ID NO: 9822 - DNA, 10 bp, Saccharomyces cerevisiae
gtaaagtact

SEQ ID NO: 9823 - DNA, 10 bp, Saccharomyces cerevisiae
gtaaagtgca

SEQ ID NO: 9824 - DNA, 10 bp, Saccharomyces cerevisiae
gtaaattact

SEQ ID NO: 9825 - DNA, 10 bp, Saccharomyces cerevisiae
gtaaattcgc

SEQ ID NO: 9826 - DNA, 10 bp, Saccharomyces cerevisiae
gtaaccactt

SEQ ID NO: 9827 - DNA, 10 bp, Saccharomyces cerevisiae
gtaaccctca

SEQ ID NO: 9828 - DNA, 10 bp, Saccharomyces cerevisiae
gtaaccgtac

SEQ ID NO: 9829 - DNA, 10 bp, Saccharomyces cerevisiae
gtaacgaaat

SEQ ID NO: 9830 - DNA, 10 bp, Saccharomyces cerevisiae
gtaacgacca

SEQ ID NO: 9831 - DNA, 10 bp, Saccharomyces cerevisiae
gtaacgagta

SEQ ID NO: 9832 - DNA, 10 bp, Saccharomyces cerevisiae
gtaacgagtg

SEQ ID NO: 9833 - DNA, 10 bp, Saccharomyces cerevisiae
gtaacttaag

SEQ ID NO: 9834 - DNA, 10 bp, Saccharomyces cerevisiae
gtaagaaaaa

SEQ ID NO: 9835 - DNA, 10 bp, Saccharomyces cerevisiae
gtaagaaaac

SEQ ID NO: 9836 - DNA, 10 bp, Saccharomyces cerevisiae
gtaagaagac

SEQ ID NO: 9837 - DNA, 10 bp, Saccharomyces cerevisiae
gtaagcgtta

SEQ ID NO: 9838 - DNA, 10 bp, Saccharomyces cerevisiae
gtaagctcga

SEQ ID NO: 9839 - DNA, 10 bp, Saccharomyces cerevisiae
gtaaggaaat

SEQ ID NO: 9840 - DNA, 10 bp, Saccharomyces cerevisiae
gtaaggcccc

SEQ ID NO: 9841 - DNA, 10 bp, Saccharomyces cerevisiae
gtaagtgaat

SEQ ID NO: 9842 - DNA, 10 bp, Saccharomyces cerevisiae
gtaagtggta

SEQ ID NO: 9843 - DNA, 10 bp, Saccharomyces cerevisiae
gtaagttcca

SEQ ID NO: 9844 - DNA, 10 bp, Saccharomyces cerevisiae
gtaagttttg

SEQ ID NO: 9845 - DNA, 10 bp, Saccharomyces cerevisiae
gtaataaaaa

SEQ ID NO: 9846 - DNA, 10 bp, Saccharomyces cerevisiae
gtaatatcca

SEQ ID NO: 9847 - DNA, 10 bp, Saccharomyces cerevisiae
gtaatatcct

SEQ ID NO: 9848 - DNA, 10 bp, Saccharomyces cerevisiae
gtaatatgtg

SEQ ID NO: 9849 - DNA, 10 bp, Saccharomyces cerevisiae
gtaatcattt

SEQ ID NO: 9850 - DNA, 10 bp, Saccharomyces cerevisiae
gtaatcttag

SEQ ID NO: 9851 - DNA, 10 bp, Saccharomyces cerevisiae
gtaatgcgac

SEQ ID NO: 9852 - DNA, 10 bp, Saccharomyces cerevisiae
gtaatggact

SEQ ID NO: 9853 - DNA, 10 bp, Saccharomyces cerevisiae
gtaatggcca

SEQ ID NO: 9854 - DNA, 10 bp, Saccharomyces cerevisiae
gtaattatcc

SEQ ID NO: 9855 - DNA, 10 bp, Saccharomyces cerevisiae
gtaatttttt

SEQ ID NO: 9856 - DNA, 10 bp, Saccharomyces cerevisiae
gtacaagtgc

SEQ ID NO: 9857 - DNA, 10 bp, Saccharomyces cerevisiae
gtacaagtgt

SEQ ID NO: 9858 - DNA, 10 bp, Saccharomyces cerevisiae
gtacaatccg

SEQ ID NO: 9859 - DNA, 10 bp, Saccharomyces cerevisiae
gtacacaata

SEQ ID NO: 9860 - DNA, 10 bp, Saccharomyces cerevisiae
gtacacaatt

SEQ ID NO: 9861 - DNA, 10 bp, Saccharomyces cerevisiae
gtacagaaaa

SEQ ID NO: 9862 - DNA, 10 bp, Saccharomyces cerevisiae
gtacataact

SEQ ID NO: 9863 - DNA, 10 bp, Saccharomyces cerevisiae
gtacatatga

SEQ ID NO: 9864 - DNA, 10 bp, Saccharomyces cerevisiae
gtaccactcc

SEQ ID NO: 9865 - DNA, 10 bp, Saccharomyces cerevisiae
gtaccctccc

SEQ ID NO: 9866 - DNA, 10 bp, Saccharomyces cerevisiae
gtacccttcg

SEQ ID NO: 9867 - DNA, 10 bp, Saccharomyces cerevisiae
gtacgagaat

SEQ ID NO: 9868 - DNA, 10 bp, Saccharomyces cerevisiae
gtacgagtat

SEQ ID NO: 9869 - DNA, 10 bp, Saccharomyces cerevisiae
gtacgattat

SEQ ID NO: 9870 - DNA, 10 bp, Saccharomyces cerevisiae
gtacgcaaga

SEQ ID NO: 9871 - DNA, 10 bp, Saccharomyces cerevisiae
gtactaaaaa

SEQ ID NO: 9872 - DNA, 10 bp, Saccharomyces cerevisiae
gtactaagga

SEQ ID NO: 9873 - DNA, 10 bp, Saccharomyces cerevisiae
gtactaattg

SEQ ID NO: 9874 - DNA, 10 bp, Saccharomyces cerevisiae
gtactctacc

SEQ ID NO: 9875 - DNA, 10 bp, Saccharomyces cerevisiae
gtacttatac

SEQ ID NO: 9876 - DNA, 10 bp, Saccharomyces cerevisiae
gtacttcaac

SEQ ID NO: 9877 - DNA, 10 bp, Saccharomyces cerevisiae
gtacttgata

SEQ ID NO: 9878 - DNA, 10 bp, Saccharomyces cerevisiae
gtactttatc

SEQ ID NO: 9879 - DNA, 10 bp, Saccharomyces cerevisiae
gtactttgaa

SEQ ID NO: 9880 - DNA, 10 bp, Saccharomyces cerevisiae
gtagaaaaaa

SEQ ID NO: 9881 - DNA, 10 bp, Saccharomyces cerevisiae
gtagaaagta

SEQ ID NO: 9882 - DNA, 10 bp, Saccharomyces cerevisiae
gtagaacatt

SEQ ID NO: 9883 - DNA, 10 bp, Saccharomyces cerevisiae
gtagaagcgg

SEQ ID NO: 9884 - DNA, 10 bp, Saccharomyces cerevisiae
gtagaatcag

SEQ ID NO: 9885 - DNA, 10 bp, Saccharomyces cerevisiae
gtagacaaga

SEQ ID NO: 9886 - DNA, 10 bp, Saccharomyces cerevisiae
gtagaccaaa

SEQ ID NO: 9887 - DNA, 10 bp, Saccharomyces cerevisiae
gtagaccggt

SEQ ID NO: 9888 - DNA, 10 bp, Saccharomyces cerevisiae
gtagagcccg

SEQ ID NO: 9889 - DNA, 10 bp, Saccharomyces cerevisiae
gtagagccgt

SEQ ID NO: 9890 - DNA, 10 bp, Saccharomyces cerevisiae
gtagagcctg

SEQ ID NO: 9891 - DNA, 10 bp, Saccharomyces cerevisiae
gtagagcgcg

SEQ ID NO: 9892 - DNA, 10 bp, Saccharomyces cerevisiae
gtagaggtgg

SEQ ID NO: 9893 - DNA, 10 bp, Saccharomyces cerevisiae
gtagagtccg

SEQ ID NO: 9894 - DNA, 10 bp, Saccharomyces cerevisiae
gtagagtcgg

SEQ ID NO: 9895 - DNA, 10 bp, Saccharomyces cerevisiae
gtagagtctg

SEQ ID NO: 9896 - DNA, 10 bp, Saccharomyces cerevisiae
gtagatgact

SEQ ID NO: 9897 - DNA, 10 bp, Saccharomyces cerevisiae
gtagatgcta

SEQ ID NO: 9898 - DNA, 10 bp, Saccharomyces cerevisiae
gtagcaagaa

SEQ ID NO: 9899 - DNA, 10 bp, Saccharomyces cerevisiae
gtagccagta

SEQ ID NO: 9900 - DNA, 10 bp, Saccharomyces cerevisiae
gtagcccacc

SEQ ID NO: 9901 - DNA, 10 bp, Saccharomyces cerevisiae
gtagccgtcg

SEQ ID NO: 9902 - DNA, 10 bp, Saccharomyces cerevisiae
gtagcgatga

SEQ ID NO: 9903 - DNA, 10 bp, Saccharomyces cerevisiae
gtagcgatgg

SEQ ID NO: 9904 - DNA, 10 bp, Saccharomyces cerevisiae
gtagcgccac

SEQ ID NO: 9905 - DNA, 10 bp, Saccharomyces cerevisiae
gtaggttcat

SEQ ID NO: 9906 - DNA, 10 bp, Saccharomyces cerevisiae
gtaggttcca

SEQ ID NO: 9907 - DNA, 10 bp, Saccharomyces cerevisiae
gtaggttcct

SEQ ID NO: 9908 - DNA, 10 bp, Saccharomyces cerevisiae
gtagtaaagg

SEQ ID NO: 9909 - DNA, 10 bp, Saccharomyces cerevisiae
gtagtacata

SEQ ID NO: 9910 - DNA, 10 bp, Saccharomyces cerevisiae
gtagtacctg

SEQ ID NO: 9911 - DNA, 10 bp, Saccharomyces cerevisiae
gtagtatatc

SEQ ID NO: 9912 - DNA, 10 bp, Saccharomyces cerevisiae
gtagtcgaat

SEQ ID NO: 9913 - DNA, 10 bp, Saccharomyces cerevisiae
gtagtgcggg

SEQ ID NO: 9914 - DNA, 10 bp, Saccharomyces cerevisiae
gtagtggaaa

SEQ ID NO: 9915 - DNA, 10 bp, Saccharomyces cerevisiae
gtagtggaag

SEQ ID NO: 9916 - DNA, 10 bp, Saccharomyces cerevisiae
gtataaaatt

SEQ ID NO: 9917 - DNA, 10 bp, Saccharomyces cerevisiae
gtataaactt

SEQ ID NO: 9918 - DNA, 10 bp, Saccharomyces cerevisiae
gtataacgat

SEQ ID NO: 9919 - DNA, 10 bp, Saccharomyces cerevisiae
gtataactgt

SEQ ID NO: 9920 - DNA, 10 bp, Saccharomyces cerevisiae
gtataatcca

SEQ ID NO: 9921 - DNA, 10 bp, Saccharomyces cerevisiae
gtatagcaat

SEQ ID NO: 9922 - DNA, 10 bp, Saccharomyces cerevisiae
gtatagccgg

SEQ ID NO: 9923 - DNA, 10 bp, Saccharomyces cerevisiae
gtatatgtgt

SEQ ID NO: 9924 - DNA, 10 bp, Saccharomyces cerevisiae
gtatattaat

SEQ ID NO: 9925 - DNA, 10 bp, Saccharomyces cerevisiae
gtatattcgt

SEQ ID NO: 9926 - DNA, 10 bp, Saccharomyces cerevisiae
gtatattttc

SEQ ID NO: 9927 - DNA, 10 bp, Saccharomyces cerevisiae
gtatattttt

SEQ ID NO: 9928 - DNA, 10 bp, Saccharomyces cerevisiae
gtatccacag

SEQ ID NO: 9929 - DNA, 10 bp, Saccharomyces cerevisiae
gtatccctga

SEQ ID NO: 9930 - DNA, 10 bp, Saccharomyces cerevisiae
gtatctaaaa

SEQ ID NO: 9931 - DNA, 10 bp, Saccharomyces cerevisiae
gtatgaacag

SEQ ID NO: 9932 - DNA, 10 bp, Saccharomyces cerevisiae
gtatggtaat

SEQ ID NO: 9933 - DNA, 10 bp, Saccharomyces cerevisiae
gtatggtcac

SEQ ID NO: 9934 - DNA, 10 bp, Saccharomyces cerevisiae
gtatgtagaa

SEQ ID NO: 9935 - DNA, 10 bp, Saccharomyces cerevisiae
gtatgtttgg

SEQ ID NO: 9936 - DNA, 10 bp, Saccharomyces cerevisiae
gtattaacta

SEQ ID NO: 9937 - DNA, 10 bp, Saccharomyces cerevisiae
gtattattag

SEQ ID NO: 9938 - DNA, 10 bp, Saccharomyces cerevisiae
gtattattat

SEQ ID NO: 9939 - DNA, 10 bp, Saccharomyces cerevisiae
gtattcagtt

SEQ ID NO: 9940 - DNA, 10 bp, Saccharomyces cerevisiae
gtattccagt

SEQ ID NO: 9941 - DNA, 10 bp, Saccharomyces cerevisiae
gtattcttcc

SEQ ID NO: 9942 - DNA, 10 bp, Saccharomyces cerevisiae
gtatttattc

SEQ ID NO: 9943 - DNA, 10 bp, Saccharomyces cerevisiae
gtatttcaaa

SEQ ID NO: 9944 - DNA, 10 bp, Saccharomyces cerevisiae
gtattttcat

SEQ ID NO: 9945 - DNA, 10 bp, Saccharomyces cerevisiae
gtattttgca

SEQ ID NO: 9946 - DNA, 10 bp, Saccharomyces cerevisiae
gtatttttgg

SEQ ID NO: 9947 - DNA, 10 bp, Saccharomyces cerevisiae
gtcaaaatag

SEQ ID NO: 9948 - DNA, 10 bp, Saccharomyces cerevisiae
gtcaaacaga

SEQ ID NO: 9949 - DNA, 10 bp, Saccharomyces cerevisiae
gtcaaatttc

SEQ ID NO: 9950 - DNA, 10 bp, Saccharomyces cerevisiae
gtcaacaaag

SEQ ID NO: 9951 - DNA, 10 bp, Saccharomyces cerevisiae
gtcaagagcg

SEQ ID NO: 9952 - DNA, 10 bp, Saccharomyces cerevisiae
gtcaagcctt

SEQ ID NO: 9953 - DNA, 10 bp, Saccharomyces cerevisiae
gtcaaggccc

SEQ ID NO: 9954 - DNA, 10 bp, Saccharomyces cerevisiae
gtcaaggttc

SEQ ID NO: 9955 - DNA, 10 bp, Saccharomyces cerevisiae
gtcaagtcaa

SEQ ID NO: 9956 - DNA, 10 bp, Saccharomyces cerevisiae
gtcaagtttc

SEQ ID NO: 9957 - DNA, 10 bp, Saccharomyces cerevisiae
gtcacaaagt

SEQ ID NO: 9958 - DNA, 10 bp, Saccharomyces cerevisiae
gtcacaagta

SEQ ID NO: 9959 - DNA, 10 bp, Saccharomyces cerevisiae
gtcacaggca

SEQ ID NO: 9960 - DNA, 10 bp, Saccharomyces cerevisiae
gtcaccaagt

SEQ ID NO: 9961 - DNA, 10 bp, Saccharomyces cerevisiae
gtcacccaat

SEQ ID NO: 9962 - DNA, 10 bp, Saccharomyces cerevisiae
gtcacccaca

SEQ ID NO: 9963 - DNA, 10 bp, Saccharomyces cerevisiae
gtcactaacg

SEQ ID NO: 9964 - DNA, 10 bp, Saccharomyces cerevisiae
gtcactggtg

SEQ ID NO: 9965 - DNA, 10 bp, Saccharomyces cerevisiae
gtcagaagag

SEQ ID NO: 9966 - DNA, 10 bp, Saccharomyces cerevisiae
gtcagatctg

SEQ ID NO: 9967 - DNA, 10 bp, Saccharomyces cerevisiae
gtcagattga

SEQ ID NO: 9968 - DNA, 10 bp, Saccharomyces cerevisiae
gtcagattgc

SEQ ID NO: 9969 - DNA, 10 bp, Saccharomyces cerevisiae
gtcagttggc

SEQ ID NO: 9970 - DNA, 10 bp, Saccharomyces cerevisiae
gtcagttggg

SEQ ID NO: 9971 - DNA, 10 bp, Saccharomyces cerevisiae
gtcataaaaa

SEQ ID NO: 9972 - DNA, 10 bp, Saccharomyces cerevisiae
gtcatactcg

SEQ ID NO: 9973 - DNA, 10 bp, Saccharomyces cerevisiae
gtcatagctg

SEQ ID NO: 9974 - DNA, 10 bp, Saccharomyces cerevisiae
gtcatatccg

SEQ ID NO: 9975 - DNA, 10 bp, Saccharomyces cerevisiae
gtcatattag

SEQ ID NO: 9976 - DNA, 10 bp, Saccharomyces cerevisiae
gtcatccagt

SEQ ID NO: 9977 - DNA, 10 bp, Saccharomyces cerevisiae
gtcatcctcc

SEQ ID NO: 9978 - DNA, 10 bp, Saccharomyces cerevisiae
gtcatcggga

SEQ ID NO: 9979 - DNA, 10 bp, Saccharomyces cerevisiae
gtcattaata

SEQ ID NO: 9980 - DNA, 10 bp, Saccharomyces cerevisiae
gtcattccaa

SEQ ID NO: 9981 - DNA, 10 bp, Saccharomyces cerevisiae
gtcattgaaa

SEQ ID NO: 9982 - DNA, 10 bp, Saccharomyces cerevisiae
gtccaacgta

SEQ ID NO: 9983 - DNA, 10 bp, Saccharomyces cerevisiae
gtccaatgtc

SEQ ID NO: 9984 - DNA, 10 bp, Saccharomyces cerevisiae
gtccaattat

SEQ ID NO: 9985 - DNA, 10 bp, Saccharomyces cerevisiae
gtccacctaa

SEQ ID NO: 9986 - DNA, 10 bp, Saccharomyces cerevisiae
gtccactgtc

SEQ ID NO: 9987 - DNA, 10 bp, Saccharomyces cerevisiae
gtccagaaca

SEQ ID NO: 9988 - DNA, 10 bp, Saccharomyces cerevisiae
gtccagcttt

SEQ ID NO: 9989 - DNA, 10 bp, Saccharomyces cerevisiae
gtccagtctc

SEQ ID NO: 9990 - DNA, 10 bp, Saccharomyces cerevisiae
gtccatcgat

SEQ ID NO: 9991 - DNA, 10 bp, Saccharomyces cerevisiae
gtcccagaac

SEQ ID NO: 9992 - DNA, 10 bp, Saccharomyces cerevisiae
gtcccagagc

SEQ ID NO: 9993 - DNA, 10 bp, Saccharomyces cerevisiae
gtccccagaa

SEQ ID NO: 9994 - DNA, 10 bp, Saccharomyces cerevisiae
gtccccattg

SEQ ID NO: 9995 - DNA, 10 bp, Saccharomyces cerevisiae
gtccccgaag

SEQ ID NO: 9996 - DNA, 10 bp, Saccharomyces cerevisiae
gtccccgcca

SEQ ID NO: 9997 - DNA, 10 bp, Saccharomyces cerevisiae
gtccccgtac

SEQ ID NO: 9998 - DNA, 10 bp, Saccharomyces cerevisiae
gtccctcaat

SEQ ID NO: 9999 - DNA, 10 bp, Saccharomyces cerevisiae
gtccctcact

SEQ ID NO: 10000 - DNA, 10 bp, Saccharomyces cerevisiae
gtccgattgg

SEQ ID NO: 10001 - DNA, 10 bp, Saccharomyces cerevisiae
gtccgccaag

SEQ ID NO: 10002 - DNA, 10 bp, Saccharomyces cerevisiae
gtccgcttgg

SEQ ID NO: 10003 - DNA, 10 bp, Saccharomyces cerevisiae
gtccggagcc

SEQ ID NO: 10004 - DNA, 10 bp, Saccharomyces cerevisiae
gtccgtatat

SEQ ID NO: 10005 - DNA, 10 bp, Saccharomyces cerevisiae
gtccgtctcc

SEQ ID NO: 10006 - DNA, 10 bp, Saccharomyces cerevisiae
gtccgttttt

SEQ ID NO: 10007 - DNA, 10 bp, Saccharomyces cerevisiae
gtcctaattg

SEQ ID NO: 10008 - DNA, 10 bp, Saccharomyces cerevisiae
gtcctccctg

SEQ ID NO: 10009 - DNA, 10 bp, Saccharomyces cerevisiae
gtcctccggg

SEQ ID NO: 10010 - DNA, 10 bp, Saccharomyces cerevisiae
gtcctgccca

SEQ ID NO: 10011 - DNA, 10 bp, Saccharomyces cerevisiae
gtcctgcgtt

SEQ ID NO: 10012 - DNA, 10 bp, Saccharomyces cerevisiae
gtccttttcc

SEQ ID NO: 10013 - DNA, 10 bp, Saccharomyces cerevisiae
gtcgaagatt

SEQ ID NO: 10014 - DNA, 10 bp, Saccharomyces cerevisiae
gtcgagccgg

SEQ ID NO: 10015 - DNA, 10 bp, Saccharomyces cerevisiae
gtcgcaaccc

SEQ ID NO: 10016 - DNA, 10 bp, Saccharomyces cerevisiae
gtcgctaaag

SEQ ID NO: 10017 - DNA, 10 bp, Saccharomyces cerevisiae
gtcggctccc

SEQ ID NO: 10018 - DNA, 10 bp, Saccharomyces cerevisiae
gtcggtacag

SEQ ID NO: 10019 - DNA, 10 bp, Saccharomyces cerevisiae
gtcggtcact

SEQ ID NO: 10020 - DNA, 10 bp, Saccharomyces cerevisiae
gtcggttcct

SEQ ID NO: 10021 - DNA, 10 bp, Saccharomyces cerevisiae
gtcgtacagg

SEQ ID NO: 10022 - DNA, 10 bp, Saccharomyces cerevisiae
gtcgtagatg

SEQ ID NO: 10023 - DNA, 10 bp, Saccharomyces cerevisiae
gtcgtgtaaa

SEQ ID NO: 10024 - DNA, 10 bp, Saccharomyces cerevisiae
gtcgttaaag

SEQ ID NO: 10025 - DNA, 10 bp, Saccharomyces cerevisiae
gtcgtttatc

SEQ ID NO: 10026 - DNA, 10 bp, Saccharomyces cerevisiae
gtctaaaaat

SEQ ID NO: 10027 - DNA, 10 bp, Saccharomyces cerevisiae
gtctaaacgt

SEQ ID NO: 10028 - DNA, 10 bp, Saccharomyces cerevisiae
gtctaaagta

SEQ ID NO: 10029 - DNA, 10 bp, Saccharomyces cerevisiae
gtctaatttt

SEQ ID NO: 10030 - DNA, 10 bp, Saccharomyces cerevisiae
gtctaccgtc

SEQ ID NO: 10031 - DNA, 10 bp, Saccharomyces cerevisiae
gtctactgtc

SEQ ID NO: 10032 - DNA, 10 bp, Saccharomyces cerevisiae
gtctagagaa

SEQ ID NO: 10033 - DNA, 10 bp, Saccharomyces cerevisiae
gtctaggaaa

SEQ ID NO: 10034 - DNA, 10 bp, Saccharomyces cerevisiae
gtctagtgat

SEQ ID NO: 10035 - DNA, 10 bp, Saccharomyces cerevisiae
gtctcaaaaa

SEQ ID NO: 10036 - DNA, 10 bp, Saccharomyces cerevisiae
gtctcaacgg

SEQ ID NO: 10037 - DNA, 10 bp, Saccharomyces cerevisiae
gtctcacata

SEQ ID NO: 10038 - DNA, 10 bp, Saccharomyces cerevisiae
gtctcagtta

SEQ ID NO: 10039 - DNA, 10 bp, Saccharomyces cerevisiae
gtctccaatt

SEQ ID NO: 10040 - DNA, 10 bp, Saccharomyces cerevisiae
gtctccctcc

SEQ ID NO: 10041 - DNA, 10 bp, Saccharomyces cerevisiae
gtctcgtgac

SEQ ID NO: 10042 - DNA, 10 bp, Saccharomyces cerevisiae
gtctcttgtc

SEQ ID NO: 10043 - DNA, 10 bp, Saccharomyces cerevisiae
gtctgaaagc

SEQ ID NO: 10044 - DNA, 10 bp, Saccharomyces cerevisiae
gtctgcaaat

SEQ ID NO: 10045 - DNA, 10 bp, Saccharomyces cerevisiae
gtctgggtgc

SEQ ID NO: 10046 - DNA, 10 bp, Saccharomyces cerevisiae
gtcttattct

SEQ ID NO: 10047 - DNA, 10 bp, Saccharomyces cerevisiae
gtcttcgtca

SEQ ID NO: 10048 - DNA, 10 bp, Saccharomyces cerevisiae
gtcttggaaa

SEQ ID NO: 10049 - DNA, 10 bp, Saccharomyces cerevisiae
gtctttaatt

SEQ ID NO: 10050 - DNA, 10 bp, Saccharomyces cerevisiae
gtctttggga

SEQ ID NO: 10051 - DNA, 10 bp, Saccharomyces cerevisiae
gtgaaaaagt

SEQ ID NO: 10052 - DNA, 10 bp, Saccharomyces cerevisiae
gtgaaaaata

SEQ ID NO: 10053 - DNA, 10 bp, Saccharomyces cerevisiae
gtgaaaacgt

SEQ ID NO: 10054 - DNA, 10 bp, Saccharomyces cerevisiae
gtgaaccatt

SEQ ID NO: 10055 - DNA, 10 bp, Saccharomyces cerevisiae
gtgaagatcg

SEQ ID NO: 10056 - DNA, 10 bp, Saccharomyces cerevisiae
gtgaaggtag

SEQ ID NO: 10057 - DNA, 10 bp, Saccharomyces cerevisiae
gtgaattttg

SEQ ID NO: 10058 - DNA, 10 bp, Saccharomyces cerevisiae
gtgactgaag

SEQ ID NO: 10059 - DNA, 10 bp, Saccharomyces cerevisiae
gtgactgtca

SEQ ID NO: 10060 - DNA, 10 bp, Saccharomyces cerevisiae
gtgactgtcc

SEQ ID NO: 10061 - DNA, 10 bp, Saccharomyces cerevisiae
gtgagacggg

SEQ ID NO: 10062 - DNA, 10 bp, Saccharomyces cerevisiae
gtgagatgag

SEQ ID NO: 10063 - DNA, 10 bp, Saccharomyces cerevisiae
gtgagcggtc

SEQ ID NO: 10064 - DNA, 10 bp, Saccharomyces cerevisiae
gtgagggacg

SEQ ID NO: 10065 - DNA, 10 bp, Saccharomyces cerevisiae
gtgagggttc

SEQ ID NO: 10066 - DNA, 10 bp, Saccharomyces cerevisiae
gtgagtgtct

SEQ ID NO: 10067 - DNA, 10 bp, Saccharomyces cerevisiae
gtgatagaaa

SEQ ID NO: 10068 - DNA, 10 bp, Saccharomyces cerevisiae
gtgatagagc

SEQ ID NO: 10069 - DNA, 10 bp, Saccharomyces cerevisiae
gtgatgaagc

SEQ ID NO: 10070 - DNA, 10 bp, Saccharomyces cerevisiae
gtgatgaccg

SEQ ID NO: 10071 - DNA, 10 bp, Saccharomyces cerevisiae
gtgatgatat

SEQ ID NO: 10072 - DNA, 10 bp, Saccharomyces cerevisiae
gtgatgtttt

SEQ ID NO: 10073 - DNA, 10 bp, Saccharomyces cerevisiae
gtgattgctc

SEQ ID NO: 10074 - DNA, 10 bp, Saccharomyces cerevisiae
gtgattgtcc

SEQ ID NO: 10075 - DNA, 10 bp, Saccharomyces cerevisiae
gtgatttaac

SEQ ID NO: 10076 - DNA, 10 bp, Saccharomyces cerevisiae
gtgcaagatc

SEQ ID NO: 10077 - DNA, 10 bp, Saccharomyces cerevisiae
gtgcaatttt

SEQ ID NO: 10078 - DNA, 10 bp, Saccharomyces cerevisiae
gtgcacatcc

SEQ ID NO: 10079 - DNA, 10 bp, Saccharomyces cerevisiae
gtgcactatc

SEQ ID NO: 10080 - DNA, 10 bp, Saccharomyces cerevisiae
gtgcactatg

SEQ ID NO: 10081 - DNA, 10 bp, Saccharomyces cerevisiae
gtgcactcta

SEQ ID NO: 10082 - DNA, 10 bp, Saccharomyces cerevisiae
gtgcagtact

SEQ ID NO: 10083 - DNA, 10 bp, Saccharomyces cerevisiae
gtgccaatgg

SEQ ID NO: 10084 - DNA, 10 bp, Saccharomyces cerevisiae
gtgccacgaa

SEQ ID NO: 10085 - DNA, 10 bp, Saccharomyces cerevisiae
gtgccagaaa

SEQ ID NO: 10086 - DNA, 10 bp, Saccharomyces cerevisiae
gtgccagtcc

SEQ ID NO: 10087 - DNA, 10 bp, Saccharomyces cerevisiae
gtgccagtct

SEQ ID NO: 10088 - DNA, 10 bp, Saccharomyces cerevisiae
gtgccgtcct

SEQ ID NO: 10089 - DNA, 10 bp, Saccharomyces cerevisiae
gtgccgtcgc

SEQ ID NO: 10090 - DNA, 10 bp, Saccharomyces cerevisiae
gtgccttaaa

SEQ ID NO: 10091 - DNA, 10 bp, Saccharomyces cerevisiae
gtgccttcca

SEQ ID NO: 10092 - DNA, 10 bp, Saccharomyces cerevisiae
gtgccttcta

SEQ ID NO: 10093 - DNA, 10 bp, Saccharomyces cerevisiae
gtgcgatcaa

SEQ ID NO: 10094 - DNA, 10 bp, Saccharomyces cerevisiae
gtgcgccatc

SEQ ID NO: 10095 - DNA, 10 bp, Saccharomyces cerevisiae
gtgcggtcac

SEQ ID NO: 10096 - DNA, 10 bp, Saccharomyces cerevisiae
gtgcggttgg

SEQ ID NO: 10097 - DNA, 10 bp, Saccharomyces cerevisiae
gtgcgttaca

SEQ ID NO: 10098 - DNA, 10 bp, Saccharomyces cerevisiae
gtgctaagat

SEQ ID NO: 10099 - DNA, 10 bp, Saccharomyces cerevisiae
gtgctagaca

SEQ ID NO: 10100 - DNA, 10 bp, Saccharomyces cerevisiae
gtgctccaac

SEQ ID NO: 10101 - DNA, 10 bp, Saccharomyces cerevisiae
gtgctccata

SEQ ID NO: 10102 - DNA, 10 bp, Saccharomyces cerevisiae
gtgctgttgt

SEQ ID NO: 10103 - DNA, 10 bp, Saccharomyces cerevisiae
gtgctttcca

SEQ ID NO: 10104 - DNA, 10 bp, Saccharomyces cerevisiae
gtgctttgtc

SEQ ID NO: 10105 - DNA, 10 bp, Saccharomyces cerevisiae
gtggaacgtt

SEQ ID NO: 10106 - DNA, 10 bp, Saccharomyces cerevisiae
gtggaagatt

SEQ ID NO: 10107 - DNA, 10 bp, Saccharomyces cerevisiae
gtggaagcac

SEQ ID NO: 10108 - DNA, 10 bp, Saccharomyces cerevisiae
gtggaagggc

SEQ ID NO: 10109 - DNA, 10 bp, Saccharomyces cerevisiae
gtggacgcca

SEQ ID NO: 10110 - DNA, 10 bp, Saccharomyces cerevisiae
gtggactaac

SEQ ID NO: 10111 - DNA, 10 bp, Saccharomyces cerevisiae
gtggatagag

SEQ ID NO: 10112 - DNA, 10 bp, Saccharomyces cerevisiae
gtggcatttc

SEQ ID NO: 10113 - DNA, 10 bp, Saccharomyces cerevisiae
gtggcctaca

SEQ ID NO: 10114 - DNA, 10 bp, Saccharomyces cerevisiae
gtggctacag

SEQ ID NO: 10115 - DNA, 10 bp, Saccharomyces cerevisiae
gtggctacat

SEQ ID NO: 10116 - DNA, 10 bp, Saccharomyces cerevisiae
gtggctgacg

SEQ ID NO: 10117 - DNA, 10 bp, Saccharomyces cerevisiae
gtgggaaatc

SEQ ID NO: 10118 - DNA, 10 bp, Saccharomyces cerevisiae
gtggggtagt

SEQ ID NO: 10119 - DNA, 10 bp, Saccharomyces cerevisiae
gtgggtctct

SEQ ID NO: 10120 - DNA, 10 bp, Saccharomyces cerevisiae
gtgggttaga

SEQ ID NO: 10121 - DNA, 10 bp, Saccharomyces cerevisiae
gtgggttcgt

SEQ ID NO: 10122 - DNA, 10 bp, Saccharomyces cerevisiae
gtggtaagca

SEQ ID NO: 10123 - DNA, 10 bp, Saccharomyces cerevisiae
gtggtaagga

SEQ ID NO: 10124 - DNA, 10 bp, Saccharomyces cerevisiae
gtggtacaaa

SEQ ID NO: 10125 - DNA, 10 bp, Saccharomyces cerevisiae
gtggtataga

SEQ ID NO: 10126 - DNA, 10 bp, Saccharomyces cerevisiae
gtggtatgat

SEQ ID NO: 10127 - DNA, 10 bp, Saccharomyces cerevisiae
gtggtatggg

SEQ ID NO: 10128 - DNA, 10 bp, Saccharomyces cerevisiae
gtggtcaggg

SEQ ID NO: 10129 - DNA, 10 bp, Saccharomyces cerevisiae
gtggtcctta

SEQ ID NO: 10130 - DNA, 10 bp, Saccharomyces cerevisiae
gtggtgcaga

SEQ ID NO: 10131 - DNA, 10 bp, Saccharomyces cerevisiae
gtggttatgt

SEQ ID NO: 10132 - DNA, 10 bp, Saccharomyces cerevisiae
gtggttcttc

SEQ ID NO: 10133 - DNA, 10 bp, Saccharomyces cerevisiae
gtggtttatt

SEQ ID NO: 10134 - DNA, 10 bp, Saccharomyces cerevisiae
gtgtaaggat

SEQ ID NO: 10135 - DNA, 10 bp, Saccharomyces cerevisiae
gtgtagaaaa

SEQ ID NO: 10136 - DNA, 10 bp, Saccharomyces cerevisiae
gtgtataagg

SEQ ID NO: 10137 - DNA, 10 bp, Saccharomyces cerevisiae
gtgtatccaa

SEQ ID NO: 10138 - DNA, 10 bp, Saccharomyces cerevisiae
gtgtatgaag

SEQ ID NO: 10139 - DNA, 10 bp, Saccharomyces cerevisiae
gtgtccattg

SEQ ID NO: 10140 - DNA, 10 bp, Saccharomyces cerevisiae
gtgtcgctgt

SEQ ID NO: 10141 - DNA, 10 bp, Saccharomyces cerevisiae
gtgtcgtcgg

SEQ ID NO: 10142 - DNA, 10 bp, Saccharomyces cerevisiae
gtgtcgtggt

SEQ ID NO: 10143 - DNA, 10 bp, Saccharomyces cerevisiae
gtgtctctga

SEQ ID NO: 10144 - DNA, 10 bp, Saccharomyces cerevisiae
gtgtgagata

SEQ ID NO: 10145 - DNA, 10 bp, Saccharomyces cerevisiae
gtgtggtaca

SEQ ID NO: 10146 - DNA, 10 bp, Saccharomyces cerevisiae
gtgtggtcat

SEQ ID NO: 10147 - DNA, 10 bp, Saccharomyces cerevisiae
gtgtggtcgc

SEQ ID NO: 10148 - DNA, 10 bp, Saccharomyces cerevisiae
gtgtgtaaga

SEQ ID NO: 10149 - DNA, 10 bp, Saccharomyces cerevisiae
gtgtgtcggc

SEQ ID NO: 10150 - DNA, 10 bp, Saccharomyces cerevisiae
gtgttaacgc

SEQ ID NO: 10151 - DNA, 10 bp, Saccharomyces cerevisiae
gtgttagggg

SEQ ID NO: 10152 - DNA, 10 bp, Saccharomyces cerevisiae
gtgttcgagc

SEQ ID NO: 10153 - DNA, 10 bp, Saccharomyces cerevisiae
gtgttcggtc

SEQ ID NO: 10154 - DNA, 10 bp, Saccharomyces cerevisiae
gtgttcttta

SEQ ID NO: 10155 - DNA, 10 bp, Saccharomyces cerevisiae
gtgttgcgga

SEQ ID NO: 10156 - DNA, 10 bp, Saccharomyces cerevisiae
gtgttggtac

SEQ ID NO: 10157 - DNA, 10 bp, Saccharomyces cerevisiae
gtgttgttgc

SEQ ID NO: 10158 - DNA, 10 bp, Saccharomyces cerevisiae
gtgtttgtat

SEQ ID NO: 10159 - DNA, 10 bp, Saccharomyces cerevisiae
gtgttttgtg

SEQ ID NO: 10160 - DNA, 10 bp, Saccharomyces cerevisiae
gtgtttttac

SEQ ID NO: 10161 - DNA, 10 bp, Saccharomyces cerevisiae
gttaaaagtt

SEQ ID NO: 10162 - DNA, 10 bp, Saccharomyces cerevisiae
gttaaagatg

SEQ ID NO: 10163 - DNA, 10 bp, Saccharomyces cerevisiae
gttaaaggtt

SEQ ID NO: 10164 - DNA, 10 bp, Saccharomyces cerevisiae
gttaaatcct

SEQ ID NO: 10165 - DNA, 10 bp, Saccharomyces cerevisiae
gttaacaaaa

SEQ ID NO: 10166 - DNA, 10 bp, Saccharomyces cerevisiae
gttaacgaat

SEQ ID NO: 10167 - DNA, 10 bp, Saccharomyces cerevisiae
gttaactggc

SEQ ID NO: 10168 - DNA, 10 bp, Saccharomyces cerevisiae
gttaactggt

SEQ ID NO: 10169 - DNA, 10 bp, Saccharomyces cerevisiae
gttaagaaca

SEQ ID NO: 10170 - DNA, 10 bp, Saccharomyces cerevisiae
gttaagatta

SEQ ID NO: 10171 - DNA, 10 bp, Saccharomyces cerevisiae
gttaagattt

SEQ ID NO: 10172 - DNA, 10 bp, Saccharomyces cerevisiae
gttaagcttg

SEQ ID NO: 10173 - DNA, 10 bp, Saccharomyces cerevisiae
gttaaggcaa

SEQ ID NO: 10174 - DNA, 10 bp, Saccharomyces cerevisiae
gttaataaaa

SEQ ID NO: 10175 - DNA, 10 bp, Saccharomyces cerevisiae
gttaataata

SEQ ID NO: 10176 - DNA, 10 bp, Saccharomyces cerevisiae
gttaatggcc

SEQ ID NO: 10177 - DNA, 10 bp, Saccharomyces cerevisiae
gttaatttta

SEQ ID NO: 10178 - DNA, 10 bp, Saccharomyces cerevisiae
gttaattttg

SEQ ID NO: 10179 - DNA, 10 bp, Saccharomyces cerevisiae
gttacaaaag

SEQ ID NO: 10180 - DNA, 10 bp, Saccharomyces cerevisiae
gttacataaa

SEQ ID NO: 10181 - DNA, 10 bp, Saccharomyces cerevisiae
gttacatttg

SEQ ID NO: 10182 - DNA, 10 bp, Saccharomyces cerevisiae
gttaccgaca

SEQ ID NO: 10183 - DNA, 10 bp, Saccharomyces cerevisiae
gttaccgctt

SEQ ID NO: 10184 - DNA, 10 bp, Saccharomyces cerevisiae
gttacggaaa

SEQ ID NO: 10185 - DNA, 10 bp, Saccharomyces cerevisiae
gttacggtca

SEQ ID NO: 10186 - DNA, 10 bp, Saccharomyces cerevisiae
gttagaaaag

SEQ ID NO: 10187 - DNA, 10 bp, Saccharomyces cerevisiae
gttagaaagg

SEQ ID NO: 10188 - DNA, 10 bp, Saccharomyces cerevisiae
gttagaaagt

SEQ ID NO: 10189 - DNA, 10 bp, Saccharomyces cerevisiae
gttagacaaa

SEQ ID NO: 10190 - DNA, 10 bp, Saccharomyces cerevisiae
gttagagtta

SEQ ID NO: 10191 - DNA, 10 bp, Saccharomyces cerevisiae
gttagcgatg

SEQ ID NO: 10192 - DNA, 10 bp, Saccharomyces cerevisiae
gttaggaaca

SEQ ID NO: 10193 - DNA, 10 bp, Saccharomyces cerevisiae
gttaggaaga

SEQ ID NO: 10194 - DNA, 10 bp, Saccharomyces cerevisiae
gttagtgttc

SEQ ID NO: 10195 - DNA, 10 bp, Saccharomyces cerevisiae
gttagtttct

SEQ ID NO: 10196 - DNA, 10 bp, Saccharomyces cerevisiae
gttataactg

SEQ ID NO: 10197 - DNA, 10 bp, Saccharomyces cerevisiae
gttataatgt

SEQ ID NO: 10198 - DNA, 10 bp, Saccharomyces cerevisiae
gttatacaac

SEQ ID NO: 10199 - DNA, 10 bp, Saccharomyces cerevisiae
gttatataaa

SEQ ID NO: 10200 - DNA, 10 bp, Saccharomyces cerevisiae
gttatatcca

SEQ ID NO: 10201 - DNA, 10 bp, Saccharomyces cerevisiae
gttatcagta

SEQ ID NO: 10202 - DNA, 10 bp, Saccharomyces cerevisiae
gttatcctgt

SEQ ID NO: 10203 - DNA, 10 bp, Saccharomyces cerevisiae
gttatcttgc

SEQ ID NO: 10204 - DNA, 10 bp, Saccharomyces cerevisiae
gttatgaaag

SEQ ID NO: 10205 - DNA, 10 bp, Saccharomyces cerevisiae
gttatgcaac

SEQ ID NO: 10206 - DNA, 10 bp, Saccharomyces cerevisiae
gttatggccc

SEQ ID NO: 10207 - DNA, 10 bp, Saccharomyces cerevisiae
gttatggccg

SEQ ID NO: 10208 - DNA, 10 bp, Saccharomyces cerevisiae
gttatgggca

SEQ ID NO: 10209 - DNA, 10 bp, Saccharomyces cerevisiae
gttatgggcc

SEQ ID NO: 10210 - DNA, 10 bp, Saccharomyces cerevisiae
gttattgtgc

SEQ ID NO: 10211 - DNA, 10 bp, Saccharomyces cerevisiae
gttcaaacag

SEQ ID NO: 10212 - DNA, 10 bp, Saccharomyces cerevisiae
gttcaaacgc

SEQ ID NO: 10213 - DNA, 10 bp, Saccharomyces cerevisiae
gttcaatatt

SEQ ID NO: 10214 - DNA, 10 bp, Saccharomyces cerevisiae
gttcaatgag

SEQ ID NO: 10215 - DNA, 10 bp, Saccharomyces cerevisiae
gttcaatttc

SEQ ID NO: 10216 - DNA, 10 bp, Saccharomyces cerevisiae
gttcaccgtc

SEQ ID NO: 10217 - DNA, 10 bp, Saccharomyces cerevisiae
gttcagagat

SEQ ID NO: 10218 - DNA, 10 bp, Saccharomyces cerevisiae
gttcaggtcc

SEQ ID NO: 10219 - DNA, 10 bp, Saccharomyces cerevisiae
gttcatccaa

SEQ ID NO: 10220 - DNA, 10 bp, Saccharomyces cerevisiae
gttcattgat

SEQ ID NO: 10221 - DNA, 10 bp, Saccharomyces cerevisiae
gttccaagga

SEQ ID NO: 10222 - DNA, 10 bp, Saccharomyces cerevisiae
gttccaaggc

SEQ ID NO: 10223 - DNA, 10 bp, Saccharomyces cerevisiae
gttccacaaa

SEQ ID NO: 10224 - DNA, 10 bp, Saccharomyces cerevisiae
gttcccaagt

SEQ ID NO: 10225 - DNA, 10 bp, Saccharomyces cerevisiae
gttccgtttc

SEQ ID NO: 10226 - DNA, 10 bp, Saccharomyces cerevisiae
gttcctcagt

SEQ ID NO: 10227 - DNA, 10 bp, Saccharomyces cerevisiae
gttcgaaaca

SEQ ID NO: 10228 - DNA, 10 bp, Saccharomyces cerevisiae
gttcgacaaa

SEQ ID NO: 10229 - DNA, 10 bp, Saccharomyces cerevisiae
gttcgcgctg

SEQ ID NO: 10230 - DNA, 10 bp, Saccharomyces cerevisiae
gttcggattt

SEQ ID NO: 10231 - DNA, 10 bp, Saccharomyces cerevisiae
gttcgtaacc

SEQ ID NO: 10232 - DNA, 10 bp, Saccharomyces cerevisiae
gttcgtgcaa

SEQ ID NO: 10233 - DNA, 10 bp, Saccharomyces cerevisiae
gttcgttcac

SEQ ID NO: 10234 - DNA, 10 bp, Saccharomyces cerevisiae
gttctaatat

SEQ ID NO: 10235 - DNA, 10 bp, Saccharomyces cerevisiae
gttctcaagt

SEQ ID NO: 10236 - DNA, 10 bp, Saccharomyces cerevisiae
gttctcccaa

SEQ ID NO: 10237 - DNA, 10 bp, Saccharomyces cerevisiae
gttctggctg

SEQ ID NO: 10238 - DNA, 10 bp, Saccharomyces cerevisiae
gttctggtga

SEQ ID NO: 10239 - DNA, 10 bp, Saccharomyces cerevisiae
gttcttaccg

SEQ ID NO: 10240 - DNA, 10 bp, Saccharomyces cerevisiae
gttcttagca

SEQ ID NO: 10241 - DNA, 10 bp, Saccharomyces cerevisiae
gttcttcaat

SEQ ID NO: 10242 - DNA, 10 bp, Saccharomyces cerevisiae
gttcttcgtt

SEQ ID NO: 10243 - DNA, 10 bp, Saccharomyces cerevisiae
gttcttgttt

SEQ ID NO: 10244 - DNA, 10 bp, Saccharomyces cerevisiae
gttctttcac

SEQ ID NO: 10245 - DNA, 10 bp, Saccharomyces cerevisiae
gttcttttta

SEQ ID NO: 10246 - DNA, 10 bp, Saccharomyces cerevisiae
gttgaaatac

SEQ ID NO: 10247 - DNA, 10 bp, Saccharomyces cerevisiae
gttgaactac

SEQ ID NO: 10248 - DNA, 10 bp, Saccharomyces cerevisiae
gttgagggtc

SEQ ID NO: 10249 - DNA, 10 bp, Saccharomyces cerevisiae
gttgcagccg

SEQ ID NO: 10250 - DNA, 10 bp, Saccharomyces cerevisiae
gttgcattta

SEQ ID NO: 10251 - DNA, 10 bp, Saccharomyces cerevisiae
gttgcctcgg

SEQ ID NO: 10252 - DNA, 10 bp, Saccharomyces cerevisiae
gttgcctctt

SEQ ID NO: 10253 - DNA, 10 bp, Saccharomyces cerevisiae
gttgctaaga

SEQ ID NO: 10254 - DNA, 10 bp, Saccharomyces cerevisiae
gttgcttcga

SEQ ID NO: 10255 - DNA, 10 bp, Saccharomyces cerevisiae
gttggaaaaa

SEQ ID NO: 10256 - DNA, 10 bp, Saccharomyces cerevisiae
gttggacggg

SEQ ID NO: 10257 - DNA, 10 bp, Saccharomyces cerevisiae
gttggagagc

SEQ ID NO: 10258 - DNA, 10 bp, Saccharomyces cerevisiae
gttggagccg

SEQ ID NO: 10259 - DNA, 10 bp, Saccharomyces cerevisiae
gttggccaat

SEQ ID NO: 10260 - DNA, 10 bp, Saccharomyces cerevisiae
gttggcctct

SEQ ID NO: 10261 - DNA, 10 bp, Saccharomyces cerevisiae
gttgggctat

SEQ ID NO: 10262 - DNA, 10 bp, Saccharomyces cerevisiae
gttggggcaa

SEQ ID NO: 10263 - DNA, 10 bp, Saccharomyces cerevisiae
gttgtaagaa

SEQ ID NO: 10264 - DNA, 10 bp, Saccharomyces cerevisiae
gttgtagcta

SEQ ID NO: 10265 - DNA, 10 bp, Saccharomyces cerevisiae
gttgtaggag

SEQ ID NO: 10266 - DNA, 10 bp, Saccharomyces cerevisiae
gttgtattaa

SEQ ID NO: 10267 - DNA, 10 bp, Saccharomyces cerevisiae
gttgtcgcaa

SEQ ID NO: 10268 - DNA, 10 bp, Saccharomyces cerevisiae
gttgtctctt

SEQ ID NO: 10269 - DNA, 10 bp, Saccharomyces cerevisiae
gttgtggaag

SEQ ID NO: 10270 - DNA, 10 bp, Saccharomyces cerevisiae
gttgtggcca

SEQ ID NO: 10271 - DNA, 10 bp, Saccharomyces cerevisiae
gttgttaacg

SEQ ID NO: 10272 - DNA, 10 bp, Saccharomyces cerevisiae
gttgttcgga

SEQ ID NO: 10273 - DNA, 10 bp, Saccharomyces cerevisiae
gttgtttaac

SEQ ID NO: 10274 - DNA, 10 bp, Saccharomyces cerevisiae
gttgtttcca

SEQ ID NO: 10275 - DNA, 10 bp, Saccharomyces cerevisiae
gttgtttgcg

SEQ ID NO: 10276 - DNA, 10 bp, Saccharomyces cerevisiae
gtttaaccca

SEQ ID NO: 10277 - DNA, 10 bp, Saccharomyces cerevisiae
gtttaacggg

SEQ ID NO: 10278 - DNA, 10 bp, Saccharomyces cerevisiae
gtttaagctc

SEQ ID NO: 10279 - DNA, 10 bp, Saccharomyces cerevisiae
gtttaatatc

SEQ ID NO: 10280 - DNA, 10 bp, Saccharomyces cerevisiae
gtttaccttt

SEQ ID NO: 10281 - DNA, 10 bp, Saccharomyces cerevisiae
gtttactgtg

SEQ ID NO: 10282 - DNA, 10 bp, Saccharomyces cerevisiae
gtttagatgg

SEQ ID NO: 10283 - DNA, 10 bp, Saccharomyces cerevisiae
gtttagtata

SEQ ID NO: 10284 - DNA, 10 bp, Saccharomyces cerevisiae
gtttataagg

SEQ ID NO: 10285 - DNA, 10 bp, Saccharomyces cerevisiae
gtttcaaaaa

SEQ ID NO: 10286 - DNA, 10 bp, Saccharomyces cerevisiae
gtttcaaaga

SEQ ID NO: 10287 - DNA, 10 bp, Saccharomyces cerevisiae
gtttcaacgc

SEQ ID NO: 10288 - DNA, 10 bp, Saccharomyces cerevisiae
gtttcaccat

SEQ ID NO: 10289 - DNA, 10 bp, Saccharomyces cerevisiae
gtttcagaca

SEQ ID NO: 10290 - DNA, 10 bp, Saccharomyces cerevisiae
gtttcccaac

SEQ ID NO: 10291 - DNA, 10 bp, Saccharomyces cerevisiae
gtttcccaag

SEQ ID NO: 10292 - DNA, 10 bp, Saccharomyces cerevisiae
gtttcccagc

SEQ ID NO: 10293 - DNA, 10 bp, Saccharomyces cerevisiae
gtttccccaa

SEQ ID NO: 10294 - DNA, 10 bp, Saccharomyces cerevisiae
gtttcctctg

SEQ ID NO: 10295 - DNA, 10 bp, Saccharomyces cerevisiae
gtttccttta

SEQ ID NO: 10296 - DNA, 10 bp, Saccharomyces cerevisiae
gtttcggttt

SEQ ID NO: 10297 - DNA, 10 bp, Saccharomyces cerevisiae
gtttctaaca

SEQ ID NO: 10298 - DNA, 10 bp, Saccharomyces cerevisiae
gtttctacgc

SEQ ID NO: 10299 - DNA, 10 bp, Saccharomyces cerevisiae
gtttctccca

SEQ ID NO: 10300 - DNA, 10 bp, Saccharomyces cerevisiae
gtttctctat

SEQ ID NO: 10301 - DNA, 10 bp, Saccharomyces cerevisiae
gtttcttcat

SEQ ID NO: 10302 - DNA, 10 bp, Saccharomyces cerevisiae
gtttgaaaca

SEQ ID NO: 10303 - DNA, 10 bp, Saccharomyces cerevisiae
gtttgaagag

SEQ ID NO: 10304 - DNA, 10 bp, Saccharomyces cerevisiae
gtttgacaca

SEQ ID NO: 10305 - DNA, 10 bp, Saccharomyces cerevisiae
gtttgatgcc

SEQ ID NO: 10306 - DNA, 10 bp, Saccharomyces cerevisiae
gtttgatgta

SEQ ID NO: 10307 - DNA, 10 bp, Saccharomyces cerevisiae
gtttgattgc

SEQ ID NO: 10308 - DNA, 10 bp, Saccharomyces cerevisiae
gtttgcgaaa

SEQ ID NO: 10309 - DNA, 10 bp, Saccharomyces cerevisiae
gtttgctcaa

SEQ ID NO: 10310 - DNA, 10 bp, Saccharomyces cerevisiae
gttttaaagt

SEQ ID NO: 10311 - DNA, 10 bp, Saccharomyces cerevisiae
gttttaacct

SEQ ID NO: 10312 - DNA, 10 bp, Saccharomyces cerevisiae
gttttaagca

SEQ ID NO: 10313 - DNA, 10 bp, Saccharomyces cerevisiae
gttttacgcg

SEQ ID NO: 10314 - DNA, 10 bp, Saccharomyces cerevisiae
gttttcaacg

SEQ ID NO: 10315 - DNA, 10 bp, Saccharomyces cerevisiae
gttttccaac

SEQ ID NO: 10316 - DNA, 10 bp, Saccharomyces cerevisiae
gttttccatt

SEQ ID NO: 10317 - DNA, 10 bp, Saccharomyces cerevisiae
gttttcggtt

SEQ ID NO: 10318 - DNA, 10 bp, Saccharomyces cerevisiae
gttttctggg

SEQ ID NO: 10319 - DNA, 10 bp, Saccharomyces cerevisiae
gttttctgtt

SEQ ID NO: 10320 - DNA, 10 bp, Saccharomyces cerevisiae
gttttcttgg

SEQ ID NO: 10321 - DNA, 10 bp, Saccharomyces cerevisiae
gttttcttta

SEQ ID NO: 10322 - DNA, 10 bp, Saccharomyces cerevisiae
gttttgatct

SEQ ID NO: 10323 - DNA, 10 bp, Saccharomyces cerevisiae
gttttgatgg

SEQ ID NO: 10324 - DNA, 10 bp, Saccharomyces cerevisiae
gttttgattg

SEQ ID NO: 10325 - DNA, 10 bp, Saccharomyces cerevisiae
gttttgccca

SEQ ID NO: 10326 - DNA, 10 bp, Saccharomyces cerevisiae
gttttggcca

SEQ ID NO: 10327 - DNA, 10 bp, Saccharomyces cerevisiae
gttttggtgg

SEQ ID NO: 10328 - DNA, 10 bp, Saccharomyces cerevisiae
gttttggttt

SEQ ID NO: 10329 - DNA, 10 bp, Saccharomyces cerevisiae
gtttttcata

SEQ ID NO: 10330 - DNA, 10 bp, Saccharomyces cerevisiae
gtttttcctt

SEQ ID NO: 10331 - DNA, 10 bp, Saccharomyces cerevisiae
gtttttcgtt

SEQ ID NO: 10332 - DNA, 10 bp, Saccharomyces cerevisiae
gtttttctat

SEQ ID NO: 10333 - DNA, 10 bp, Saccharomyces cerevisiae
gtttttctct

SEQ ID NO: 10334 - DNA, 10 bp, Saccharomyces cerevisiae
gtttttctgt

SEQ ID NO: 10335 - DNA, 10 bp, Saccharomyces cerevisiae
gtttttctta

SEQ ID NO: 10336 - DNA, 10 bp, Saccharomyces cerevisiae
gtttttgctt

SEQ ID NO: 10337 - DNA, 10 bp, Saccharomyces cerevisiae
gtttttggtt

SEQ ID NO: 10338 - DNA, 10 bp, Saccharomyces cerevisiae
gtttttttga

SEQ ID NO: 10339 - DNA, 10 bp, Saccharomyces cerevisiae
taaaaaaaat

SEQ ID NO: 10340 - DNA, 10 bp, Saccharomyces cerevisiae
taaaaaagaa

SEQ ID NO: 10341 - DNA, 10 bp, Saccharomyces cerevisiae
taaaaaaggt

SEQ ID NO: 10342 - DNA, 10 bp, Saccharomyces cerevisiae
taaaaaatgg

SEQ ID NO: 10343 - DNA, 10 bp, Saccharomyces cerevisiae
taaaaatcta

SEQ ID NO: 10344 - DNA, 10 bp, Saccharomyces cerevisiae
taaaaatctg

SEQ ID NO: 10345 - DNA, 10 bp, Saccharomyces cerevisiae
taaaaattac

SEQ ID NO: 10346 - DNA, 10 bp, Saccharomyces cerevisiae
taaaacgatt

SEQ ID NO: 10347 - DNA, 10 bp, Saccharomyces cerevisiae
taaaagactg

SEQ ID NO: 10348 - DNA, 10 bp, Saccharomyces cerevisiae
taaaatcgtt

SEQ ID NO: 10349 - DNA, 10 bp, Saccharomyces cerevisiae
taaacaattt

SEQ ID NO: 10350 - DNA, 10 bp, Saccharomyces cerevisiae
taaacactaa

SEQ ID NO: 10351 - DNA, 10 bp, Saccharomyces cerevisiae
taaaccaatt

SEQ ID NO: 10352 - DNA, 10 bp, Saccharomyces cerevisiae
taaactacaa

SEQ ID NO: 10353 - DNA, 10 bp, Saccharomyces cerevisiae
taaacttatt

SEQ ID NO: 10354 - DNA, 10 bp, Saccharomyces cerevisiae
taaagaaatg

SEQ ID NO: 10355 - DNA, 10 bp, Saccharomyces cerevisiae
taaagaagtc

SEQ ID NO: 10356 - DNA, 10 bp, Saccharomyces cerevisiae
taaagacata

SEQ ID NO: 10357 - DNA, 10 bp, Saccharomyces cerevisiae
taaagatctg

SEQ ID NO: 10358 - DNA, 10 bp, Saccharomyces cerevisiae
taaagctggg

SEQ ID NO: 10359 - DNA, 10 bp, Saccharomyces cerevisiae
taaagggaag

SEQ ID NO: 10360 - DNA, 10 bp, Saccharomyces cerevisiae
taaagtaaaa

SEQ ID NO: 10361 - DNA, 10 bp, Saccharomyces cerevisiae
taaagtagca

SEQ ID NO: 10362 - DNA, 10 bp, Saccharomyces cerevisiae
taaataaaat

SEQ ID NO: 10363 - DNA, 10 bp, Saccharomyces cerevisiae
taaataaata

SEQ ID NO: 10364 - DNA, 10 bp, Saccharomyces cerevisiae
taaataatta

SEQ ID NO: 10365 - DNA, 10 bp, Saccharomyces cerevisiae
taaatacagt

SEQ ID NO: 10366 - DNA, 10 bp, Saccharomyces cerevisiae
taaatacata

SEQ ID NO: 10367 - DNA, 10 bp, Saccharomyces cerevisiae
taaatacggc

SEQ ID NO: 10368 - DNA, 10 bp, Saccharomyces cerevisiae
taaatactaa

SEQ ID NO: 10369 - DNA, 10 bp, Saccharomyces cerevisiae
taaatacttt

SEQ ID NO: 10370 - DNA, 10 bp, Saccharomyces cerevisiae
taaatataac

SEQ ID NO: 10371 - DNA, 10 bp, Saccharomyces cerevisiae
taaatatcat

SEQ ID NO: 10372 - DNA, 10 bp, Saccharomyces cerevisiae
taaatcggtg

SEQ ID NO: 10373 - DNA, 10 bp, Saccharomyces cerevisiae
taaatctgga

SEQ ID NO: 10374 - DNA, 10 bp, Saccharomyces cerevisiae
taaatggagc

SEQ ID NO: 10375 - DNA, 10 bp, Saccharomyces cerevisiae
taaatgggtt

SEQ ID NO: 10376 - DNA, 10 bp, Saccharomyces cerevisiae
taaatgttgt

SEQ ID NO: 10377 - DNA, 10 bp, Saccharomyces cerevisiae
taaattaaaa

SEQ ID NO: 10378 - DNA, 10 bp, Saccharomyces cerevisiae
taaattacta

SEQ ID NO: 10379 - DNA, 10 bp, Saccharomyces cerevisiae
taaattggtg

SEQ ID NO: 10380 - DNA, 10 bp, Saccharomyces cerevisiae
taaattttga

SEQ ID NO: 10381 - DNA, 10 bp, Saccharomyces cerevisiae
taacaaaaaa

SEQ ID NO: 10382 - DNA, 10 bp, Saccharomyces cerevisiae
taacaatgca

SEQ ID NO: 10383 - DNA, 10 bp, Saccharomyces cerevisiae
taacactcct

SEQ ID NO: 10384 - DNA, 10 bp, Saccharomyces cerevisiae
taacacttct

SEQ ID NO: 10385 - DNA, 10 bp, Saccharomyces cerevisiae
taacagccct

SEQ ID NO: 10386 - DNA, 10 bp, Saccharomyces cerevisiae
taacataaat

SEQ ID NO: 10387 - DNA, 10 bp, Saccharomyces cerevisiae
taacattgtg

SEQ ID NO: 10388 - DNA, 10 bp, Saccharomyces cerevisiae
taaccagcga

SEQ ID NO: 10389 - DNA, 10 bp, Saccharomyces cerevisiae
taaccattta

SEQ ID NO: 10390 - DNA, 10 bp, Saccharomyces cerevisiae
taaccgcagt

SEQ ID NO: 10391 - DNA, 10 bp, Saccharomyces cerevisiae
taaccggact

SEQ ID NO: 10392 - DNA, 10 bp, Saccharomyces cerevisiae
taaccgtccc

SEQ ID NO: 10393 - DNA, 10 bp, Saccharomyces cerevisiae
taacctatcc

SEQ ID NO: 10394 - DNA, 10 bp, Saccharomyces cerevisiae
taacctcgta

SEQ ID NO: 10395 - DNA, 10 bp, Saccharomyces cerevisiae
taacctgaca

SEQ ID NO: 10396 - DNA, 10 bp, Saccharomyces cerevisiae
taacgagtag

SEQ ID NO: 10397 - DNA, 10 bp, Saccharomyces cerevisiae
taacgcgttg

SEQ ID NO: 10398 - DNA, 10 bp, Saccharomyces cerevisiae
taactagact

SEQ ID NO: 10399 - DNA, 10 bp, Saccharomyces cerevisiae
taactcccta

SEQ ID NO: 10400 - DNA, 10 bp, Saccharomyces cerevisiae
taactccctt

SEQ ID NO: 10401 - DNA, 10 bp, Saccharomyces cerevisiae
taactggaca

SEQ ID NO: 10402 - DNA, 10 bp, Saccharomyces cerevisiae
taactggacc

SEQ ID NO: 10403 - DNA, 10 bp, Saccharomyces cerevisiae
taactgggac

SEQ ID NO: 10404 - DNA, 10 bp, Saccharomyces cerevisiae
taactggtct

SEQ ID NO: 10405 - DNA, 10 bp, Saccharomyces cerevisiae
taagaaaaaa

SEQ ID NO: 10406 - DNA, 10 bp, Saccharomyces cerevisiae
taagaactct

SEQ ID NO: 10407 - DNA, 10 bp, Saccharomyces cerevisiae
taagaatcct

SEQ ID NO: 10408 - DNA, 10 bp, Saccharomyces cerevisiae
taagaattcc

SEQ ID NO: 10409 - DNA, 10 bp, Saccharomyces cerevisiae
taagacaact

SEQ ID NO: 10410 - DNA, 10 bp, Saccharomyces cerevisiae
taagacagtg

SEQ ID NO: 10411 - DNA, 10 bp, Saccharomyces cerevisiae
taagaccttt

SEQ ID NO: 10412 - DNA, 10 bp, Saccharomyces cerevisiae
taagataaat

SEQ ID NO: 10413 - DNA, 10 bp, Saccharomyces cerevisiae
taagattgct

SEQ ID NO: 10414 - DNA, 10 bp, Saccharomyces cerevisiae
taagcaagaa

SEQ ID NO: 10415 - DNA, 10 bp, Saccharomyces cerevisiae
taagcagatg

SEQ ID NO: 10416 - DNA, 10 bp, Saccharomyces cerevisiae
taagctgtgg

SEQ ID NO: 10417 - DNA, 10 bp, Saccharomyces cerevisiae
taaggacccc

SEQ ID NO: 10418 - DNA, 10 bp, Saccharomyces cerevisiae
taaggagtca

SEQ ID NO: 10419 - DNA, 10 bp, Saccharomyces cerevisiae
taaggctatc

SEQ ID NO: 10420 - DNA, 10 bp, Saccharomyces cerevisiae
taagggaatt

SEQ ID NO: 10421 - DNA, 10 bp, Saccharomyces cerevisiae
taaggttatt

SEQ ID NO: 10422 - DNA, 10 bp, Saccharomyces cerevisiae
taagtataca

SEQ ID NO: 10423 - DNA, 10 bp, Saccharomyces cerevisiae
taagtgaaca

SEQ ID NO: 10424 - DNA, 10 bp, Saccharomyces cerevisiae
taagttaaca

SEQ ID NO: 10425 - DNA, 10 bp, Saccharomyces cerevisiae
taagttatac

SEQ ID NO: 10426 - DNA, 10 bp, Saccharomyces cerevisiae
taagttcgtt

SEQ ID NO: 10427 - DNA, 10 bp, Saccharomyces cerevisiae
taagtttcta

SEQ ID NO: 10428 - DNA, 10 bp, Saccharomyces cerevisiae
taataaacgg

SEQ ID NO: 10429 - DNA, 10 bp, Saccharomyces cerevisiae
taataagaag

SEQ ID NO: 10430 - DNA, 10 bp, Saccharomyces cerevisiae
taataataat

SEQ ID NO: 10431 - DNA, 10 bp, Saccharomyces cerevisiae
taatacatct

SEQ ID NO: 10432 - DNA, 10 bp, Saccharomyces cerevisiae
taatactaca

SEQ ID NO: 10433 - DNA, 10 bp, Saccharomyces cerevisiae
taatactagg

SEQ ID NO: 10434 - DNA, 10 bp, Saccharomyces cerevisiae
taatacttgc

SEQ ID NO: 10435 - DNA, 10 bp, Saccharomyces cerevisiae
taatagattt

SEQ ID NO: 10436 - DNA, 10 bp, Saccharomyces cerevisiae
taatagttgg

SEQ ID NO: 10437 - DNA, 10 bp, Saccharomyces cerevisiae
taatatggga

SEQ ID NO: 10438 - DNA, 10 bp, Saccharomyces cerevisiae
taatatttga

SEQ ID NO: 10439 - DNA, 10 bp, Saccharomyces cerevisiae
taatcagcga

SEQ ID NO: 10440 - DNA, 10 bp, Saccharomyces cerevisiae
taatcatagt

SEQ ID NO: 10441 - DNA, 10 bp, Saccharomyces cerevisiae
taatcgttca

SEQ ID NO: 10442 - DNA, 10 bp, Saccharomyces cerevisiae
taatgaggtc

SEQ ID NO: 10443 - DNA, 10 bp, Saccharomyces cerevisiae
taatgcaaca

SEQ ID NO: 10444 - DNA, 10 bp, Saccharomyces cerevisiae
taatgtcatc

SEQ ID NO: 10445 - DNA, 10 bp, Saccharomyces cerevisiae
taattacatt

SEQ ID NO: 10446 - DNA, 10 bp, Saccharomyces cerevisiae
taattactta

SEQ ID NO: 10447 - DNA, 10 bp, Saccharomyces cerevisiae
taattacttt

SEQ ID NO: 10448 - DNA, 10 bp, Saccharomyces cerevisiae
taattcctag

SEQ ID NO: 10449 - DNA, 10 bp, Saccharomyces cerevisiae
taattcctta

SEQ ID NO: 10450 - DNA, 10 bp, Saccharomyces cerevisiae
taattctttt

SEQ ID NO: 10451 - DNA, 10 bp, Saccharomyces cerevisiae
taattgggca

SEQ ID NO: 10452 - DNA, 10 bp, Saccharomyces cerevisiae
taattggttg

SEQ ID NO: 10453 - DNA, 10 bp, Saccharomyces cerevisiae
taatttaaaa

SEQ ID NO: 10454 - DNA, 10 bp, Saccharomyces cerevisiae
taatttcctc

SEQ ID NO: 10455 - DNA, 10 bp, Saccharomyces cerevisiae
taatttctat

SEQ ID NO: 10456 - DNA, 10 bp, Saccharomyces cerevisiae
taatttctta

SEQ ID NO: 10457 - DNA, 10 bp, Saccharomyces cerevisiae
taatttttaa

SEQ ID NO: 10458 - DNA, 10 bp, Saccharomyces cerevisiae
taatttttta

SEQ ID NO: 10459 - DNA, 10 bp, Saccharomyces cerevisiae
tacaaaacag

SEQ ID NO: 10460 - DNA, 10 bp, Saccharomyces cerevisiae
tacaaaagaa

SEQ ID NO: 10461 - DNA, 10 bp, Saccharomyces cerevisiae
tacaaacctt

SEQ ID NO: 10462 - DNA, 10 bp, Saccharomyces cerevisiae
tacaaagaga

SEQ ID NO: 10463 - DNA, 10 bp, Saccharomyces cerevisiae
tacaaattat

SEQ ID NO: 10464 - DNA, 10 bp, Saccharomyces cerevisiae
tacaaattta

SEQ ID NO: 10465 - DNA, 10 bp, Saccharomyces cerevisiae
tacaaatttt

SEQ ID NO: 10466 - DNA, 10 bp, Saccharomyces cerevisiae
tacaagacaa

SEQ ID NO: 10467 - DNA, 10 bp, Saccharomyces cerevisiae
tacaataatg

SEQ ID NO: 10468 - DNA, 10 bp, Saccharomyces cerevisiae
tacaataatt

SEQ ID NO: 10469 - DNA, 10 bp, Saccharomyces cerevisiae
tacaatatga

SEQ ID NO: 10470 - DNA, 10 bp, Saccharomyces cerevisiae
tacaatgacg

SEQ ID NO: 10471 - DNA, 10 bp, Saccharomyces cerevisiae
tacaatttaa

SEQ ID NO: 10472 - DNA, 10 bp, Saccharomyces cerevisiae
tacaatttca

SEQ ID NO: 10473 - DNA, 10 bp, Saccharomyces cerevisiae
tacaatttga

SEQ ID NO: 10474 - DNA, 10 bp, Saccharomyces cerevisiae
tacaattttc

SEQ ID NO: 10475 - DNA, 10 bp, Saccharomyces cerevisiae
tacacaaaga

SEQ ID NO: 10476 - DNA, 10 bp, Saccharomyces cerevisiae
tacacaactt

SEQ ID NO: 10477 - DNA, 10 bp, Saccharomyces cerevisiae
tacacaagaa

SEQ ID NO: 10478 - DNA, 10 bp, Saccharomyces cerevisiae
tacacaatct

SEQ ID NO: 10479 - DNA, 10 bp, Saccharomyces cerevisiae
tacacaatta

SEQ ID NO: 10480 - DNA, 10 bp, Saccharomyces cerevisiae
tacacaattg

SEQ ID NO: 10481 - DNA, 10 bp, Saccharomyces cerevisiae
tacacacgta

SEQ ID NO: 10482 - DNA, 10 bp, Saccharomyces cerevisiae
tacacactca

SEQ ID NO: 10483 - DNA, 10 bp, Saccharomyces cerevisiae
tacacagttt

SEQ ID NO: 10484 - DNA, 10 bp, Saccharomyces cerevisiae
tacacatttt

SEQ ID NO: 10485 - DNA, 10 bp, Saccharomyces cerevisiae
tacaccaagc

SEQ ID NO: 10486 - DNA, 10 bp, Saccharomyces cerevisiae
tacaccctta

SEQ ID NO: 10487 - DNA, 10 bp, Saccharomyces cerevisiae
tacacctagt

SEQ ID NO: 10488 - DNA, 10 bp, Saccharomyces cerevisiae
tacacgcgct

SEQ ID NO: 10489 - DNA, 10 bp, Saccharomyces cerevisiae
tacacgtagg

SEQ ID NO: 10490 - DNA, 10 bp, Saccharomyces cerevisiae
tacactagga

SEQ ID NO: 10491 - DNA, 10 bp, Saccharomyces cerevisiae
tacactcctt

SEQ ID NO: 10492 - DNA, 10 bp, Saccharomyces cerevisiae
tacactctaa

SEQ ID NO: 10493 - DNA, 10 bp, Saccharomyces cerevisiae
tacagaaaat

SEQ ID NO: 10494 - DNA, 10 bp, Saccharomyces cerevisiae
tacagacaca

SEQ ID NO: 10495 - DNA, 10 bp, Saccharomyces cerevisiae
tacagcatcc

SEQ ID NO: 10496 - DNA, 10 bp, Saccharomyces cerevisiae
tacagcggta

SEQ ID NO: 10497 - DNA, 10 bp, Saccharomyces cerevisiae
tacaggcaaa

SEQ ID NO: 10498 - DNA, 10 bp, Saccharomyces cerevisiae
tacagtagtg

SEQ ID NO: 10499 - DNA, 10 bp, Saccharomyces cerevisiae
tacagtcttg

SEQ ID NO: 10500 - DNA, 10 bp, Saccharomyces cerevisiae
tacatacatc

SEQ ID NO: 10501 - DNA, 10 bp, Saccharomyces cerevisiae
tacatataaa

SEQ ID NO: 10502 - DNA, 10 bp, Saccharomyces cerevisiae
tacatcaatt

SEQ ID NO: 10503 - DNA, 10 bp, Saccharomyces cerevisiae
tacattgaac

SEQ ID NO: 10504 - DNA, 10 bp, Saccharomyces cerevisiae
tacatttttc

SEQ ID NO: 10505 - DNA, 10 bp, Saccharomyces cerevisiae
taccaatcac

SEQ ID NO: 10506 - DNA, 10 bp, Saccharomyces cerevisiae
taccaatcat

SEQ ID NO: 10507 - DNA, 10 bp, Saccharomyces cerevisiae
taccaatcct

SEQ ID NO: 10508 - DNA, 10 bp, Saccharomyces cerevisiae
taccaatcta

SEQ ID NO: 10509 - DNA, 10 bp, Saccharomyces cerevisiae
taccaatgtc

SEQ ID NO: 10510 - DNA, 10 bp, Saccharomyces cerevisiae
taccacacct

SEQ ID NO: 10511 - DNA, 10 bp, Saccharomyces cerevisiae
taccacccgt

SEQ ID NO: 10512 - DNA, 10 bp, Saccharomyces cerevisiae
taccacgttg

SEQ ID NO: 10513 - DNA, 10 bp, Saccharomyces cerevisiae
taccactctt

SEQ ID NO: 10514 - DNA, 10 bp, Saccharomyces cerevisiae
taccacttct

SEQ ID NO: 10515 - DNA, 10 bp, Saccharomyces cerevisiae
taccagaaat

SEQ ID NO: 10516 - DNA, 10 bp, Saccharomyces cerevisiae
taccagctac

SEQ ID NO: 10517 - DNA, 10 bp, Saccharomyces cerevisiae
taccatcttt

SEQ ID NO: 10518 - DNA, 10 bp, Saccharomyces cerevisiae
tacccactcc

SEQ ID NO: 10519 - DNA, 10 bp, Saccharomyces cerevisiae
tacccattga

SEQ ID NO: 10520 - DNA, 10 bp, Saccharomyces cerevisiae
taccccgtac

SEQ ID NO: 10521 - DNA, 10 bp, Saccharomyces cerevisiae
tacccctcct

SEQ ID NO: 10522 - DNA, 10 bp, Saccharomyces cerevisiae
tacccgagga

SEQ ID NO: 10523 - DNA, 10 bp, Saccharomyces cerevisiae
tacccgtaaa

SEQ ID NO: 10524 - DNA, 10 bp, Saccharomyces cerevisiae
taccggcagc

SEQ ID NO: 10525 - DNA, 10 bp, Saccharomyces cerevisiae
taccgtcttt

SEQ ID NO: 10526 - DNA, 10 bp, Saccharomyces cerevisiae
taccgttaat

SEQ ID NO: 10527 - DNA, 10 bp, Saccharomyces cerevisiae
taccgttatc

SEQ ID NO: 10528 - DNA, 10 bp, Saccharomyces cerevisiae
tacctaattg

SEQ ID NO: 10529 - DNA, 10 bp, Saccharomyces cerevisiae
tacctagttt

SEQ ID NO: 10530 - DNA, 10 bp, Saccharomyces cerevisiae
tacctccaac

SEQ ID NO: 10531 - DNA, 10 bp, Saccharomyces cerevisiae
tacctcctcg

SEQ ID NO: 10532 - DNA, 10 bp, Saccharomyces cerevisiae
tacctgtaaa

SEQ ID NO: 10533 - DNA, 10 bp, Saccharomyces cerevisiae
tacctttcct

SEQ ID NO: 10534 - DNA, 10 bp, Saccharomyces cerevisiae
tacctttgaa

SEQ ID NO: 10535 - DNA, 10 bp, Saccharomyces cerevisiae
tacgaagctg

SEQ ID NO: 10536 - DNA, 10 bp, Saccharomyces cerevisiae
tacgacatat

SEQ ID NO: 10537 - DNA, 10 bp, Saccharomyces cerevisiae
tacgagataa

SEQ ID NO: 10538 - DNA, 10 bp, Saccharomyces cerevisiae
tacgatgctt

SEQ ID NO: 10539 - DNA, 10 bp, Saccharomyces cerevisiae
tacgatttta

SEQ ID NO: 10540 - DNA, 10 bp, Saccharomyces cerevisiae
tacgcaattt

SEQ ID NO: 10541 - DNA, 10 bp, Saccharomyces cerevisiae
tacgcatcgt

SEQ ID NO: 10542 - DNA, 10 bp, Saccharomyces cerevisiae
tacgccaagc

SEQ ID NO: 10543 - DNA, 10 bp, Saccharomyces cerevisiae
tacgcgctac

SEQ ID NO: 10544 - DNA, 10 bp, Saccharomyces cerevisiae
tacggaggcc

SEQ ID NO: 10545 - DNA, 10 bp, Saccharomyces cerevisiae
tacggcgtgt

SEQ ID NO: 10546 - DNA, 10 bp, Saccharomyces cerevisiae
tacgggtcac

SEQ ID NO: 10547 - DNA, 10 bp, Saccharomyces cerevisiae
tacgggttac

SEQ ID NO: 10548 - DNA, 10 bp, Saccharomyces cerevisiae
tacggtattt

SEQ ID NO: 10549 - DNA, 10 bp, Saccharomyces cerevisiae
tacgtaagta

SEQ ID NO: 10550 - DNA, 10 bp, Saccharomyces cerevisiae
tacgtagata

SEQ ID NO: 10551 - DNA, 10 bp, Saccharomyces cerevisiae
tacgtatata

SEQ ID NO: 10552 - DNA, 10 bp, Saccharomyces cerevisiae
tacgtcggtg

SEQ ID NO: 10553 - DNA, 10 bp, Saccharomyces cerevisiae
tacgtctgta

SEQ ID NO: 10554 - DNA, 10 bp, Saccharomyces cerevisiae
tacgtctgtt

SEQ ID NO: 10555 - DNA, 10 bp, Saccharomyces cerevisiae
tacgttcact

SEQ ID NO: 10556 - DNA, 10 bp, Saccharomyces cerevisiae
tactaaaaaa

SEQ ID NO: 10557 - DNA, 10 bp, Saccharomyces cerevisiae
tactaaaata

SEQ ID NO: 10558 - DNA, 10 bp, Saccharomyces cerevisiae
tactacggtg

SEQ ID NO: 10559 - DNA, 10 bp, Saccharomyces cerevisiae
tactaggtga

SEQ ID NO: 10560 - DNA, 10 bp, Saccharomyces cerevisiae
tactagttcg

SEQ ID NO: 10561 - DNA, 10 bp, Saccharomyces cerevisiae
tactattgag

SEQ ID NO: 10562 - DNA, 10 bp, Saccharomyces cerevisiae
tactcactca

SEQ ID NO: 10563 - DNA, 10 bp, Saccharomyces cerevisiae
tactcgaaat

SEQ ID NO: 10564 - DNA, 10 bp, Saccharomyces cerevisiae
tactcggcgg

SEQ ID NO: 10565 - DNA, 10 bp, Saccharomyces cerevisiae
tactctgcga

SEQ ID NO: 10566 - DNA, 10 bp, Saccharomyces cerevisiae
tactcttcgt

SEQ ID NO: 10567 - DNA, 10 bp, Saccharomyces cerevisiae
tactgagtgc

SEQ ID NO: 10568 - DNA, 10 bp, Saccharomyces cerevisiae
tactgcaact

SEQ ID NO: 10569 - DNA, 10 bp, Saccharomyces cerevisiae
tactgctttc

SEQ ID NO: 10570 - DNA, 10 bp, Saccharomyces cerevisiae
tactggaggt

SEQ ID NO: 10571 - DNA, 10 bp, Saccharomyces cerevisiae
tactgtttct

SEQ ID NO: 10572 - DNA, 10 bp, Saccharomyces cerevisiae
tacttaaatt

SEQ ID NO: 10573 - DNA, 10 bp, Saccharomyces cerevisiae
tacttaccgc

SEQ ID NO: 10574 - DNA, 10 bp, Saccharomyces cerevisiae
tacttacgta

SEQ ID NO: 10575 - DNA, 10 bp, Saccharomyces cerevisiae
tacttcaacc

SEQ ID NO: 10576 - DNA, 10 bp, Saccharomyces cerevisiae
tacttcacta

SEQ ID NO: 10577 - DNA, 10 bp, Saccharomyces cerevisiae
tacttcatct

SEQ ID NO: 10578 - DNA, 10 bp, Saccharomyces cerevisiae
tacttctaaa

SEQ ID NO: 10579 - DNA, 10 bp, Saccharomyces cerevisiae
tacttctcgt

SEQ ID NO: 10580 - DNA, 10 bp, Saccharomyces cerevisiae
tacttctctg

SEQ ID NO: 10581 - DNA, 10 bp, Saccharomyces cerevisiae
tacttgaact

SEQ ID NO: 10582 - DNA, 10 bp, Saccharomyces cerevisiae
tactttaaaa

SEQ ID NO: 10583 - DNA, 10 bp, Saccharomyces cerevisiae
tactttacct

SEQ ID NO: 10584 - DNA, 10 bp, Saccharomyces cerevisiae
tactttgatg

SEQ ID NO: 10585 - DNA, 10 bp, Saccharomyces cerevisiae
tacttttcat

SEQ ID NO: 10586 - DNA, 10 bp, Saccharomyces cerevisiae
tacttttctg

SEQ ID NO: 10587 - DNA, 10 bp, Saccharomyces cerevisiae
tagaaaaaaa

SEQ ID NO: 10588 - DNA, 10 bp, Saccharomyces cerevisiae
tagaaaaggc

SEQ ID NO: 10589 - DNA, 10 bp, Saccharomyces cerevisiae
tagaaaccat

SEQ ID NO: 10590 - DNA, 10 bp, Saccharomyces cerevisiae
tagaacatta

SEQ ID NO: 10591 - DNA, 10 bp, Saccharomyces cerevisiae
tagaagccag

SEQ ID NO: 10592 - DNA, 10 bp, Saccharomyces cerevisiae
tagaatgact

SEQ ID NO: 10593 - DNA, 10 bp, Saccharomyces cerevisiae
tagaatgcat

SEQ ID NO: 10594 - DNA, 10 bp, Saccharomyces cerevisiae
tagaatgtca

SEQ ID NO: 10595 - DNA, 10 bp, Saccharomyces cerevisiae
tagaatttca

SEQ ID NO: 10596 - DNA, 10 bp, Saccharomyces cerevisiae
tagacagttc

SEQ ID NO: 10597 - DNA, 10 bp, Saccharomyces cerevisiae
tagacggttg

SEQ ID NO: 10598 - DNA, 10 bp, Saccharomyces cerevisiae
tagacgttta

SEQ ID NO: 10599 - DNA, 10 bp, Saccharomyces cerevisiae
tagagaagta

SEQ ID NO: 10600 - DNA, 10 bp, Saccharomyces cerevisiae
tagagagtac

SEQ ID NO: 10601 - DNA, 10 bp, Saccharomyces cerevisiae
tagaggggcg

SEQ ID NO: 10602 - DNA, 10 bp, Saccharomyces cerevisiae
tagaggttac

SEQ ID NO: 10603 - DNA, 10 bp, Saccharomyces cerevisiae
tagatacaaa

SEQ ID NO: 10604 - DNA, 10 bp, Saccharomyces cerevisiae
tagatagcag

SEQ ID NO: 10605 - DNA, 10 bp, Saccharomyces cerevisiae
tagatgtcca

SEQ ID NO: 10606 - DNA, 10 bp, Saccharomyces cerevisiae
tagattagga

SEQ ID NO: 10607 - DNA, 10 bp, Saccharomyces cerevisiae
tagcaagagg

SEQ ID NO: 10608 - DNA, 10 bp, Saccharomyces cerevisiae
tagcacctta

SEQ ID NO: 10609 - DNA, 10 bp, Saccharomyces cerevisiae
tagcactaaa

SEQ ID NO: 10610 - DNA, 10 bp, Saccharomyces cerevisiae
tagcacttca

SEQ ID NO: 10611 - DNA, 10 bp, Saccharomyces cerevisiae
tagcacttct

SEQ ID NO: 10612 - DNA, 10 bp, Saccharomyces cerevisiae
tagcaggcgg

SEQ ID NO: 10613 - DNA, 10 bp, Saccharomyces cerevisiae
tagcattgca

SEQ ID NO: 10614 - DNA, 10 bp, Saccharomyces cerevisiae
tagcatttgc

SEQ ID NO: 10615 - DNA, 10 bp, Saccharomyces cerevisiae
tagccaagtt

SEQ ID NO: 10616 - DNA, 10 bp, Saccharomyces cerevisiae
tagcccaact

SEQ ID NO: 10617 - DNA, 10 bp, Saccharomyces cerevisiae
tagcccctca

SEQ ID NO: 10618 - DNA, 10 bp, Saccharomyces cerevisiae
tagccctaaa

SEQ ID NO: 10619 - DNA, 10 bp, Saccharomyces cerevisiae
tagccggtct

SEQ ID NO: 10620 - DNA, 10 bp, Saccharomyces cerevisiae
tagcgcaact

SEQ ID NO: 10621 - DNA, 10 bp, Saccharomyces cerevisiae
tagctacaac

SEQ ID NO: 10622 - DNA, 10 bp, Saccharomyces cerevisiae
tagcttctca

SEQ ID NO: 10623 - DNA, 10 bp, Saccharomyces cerevisiae
taggacaata

SEQ ID NO: 10624 - DNA, 10 bp, Saccharomyces cerevisiae
taggacgcca

SEQ ID NO: 10625 - DNA, 10 bp, Saccharomyces cerevisiae
taggagaaac

SEQ ID NO: 10626 - DNA, 10 bp, Saccharomyces cerevisiae
taggagtctc

SEQ ID NO: 10627 - DNA, 10 bp, Saccharomyces cerevisiae
taggcaccag

SEQ ID NO: 10628 - DNA, 10 bp, Saccharomyces cerevisiae
taggccgcaa

SEQ ID NO: 10629 - DNA, 10 bp, Saccharomyces cerevisiae
tagggaaaat

SEQ ID NO: 10630 - DNA, 10 bp, Saccharomyces cerevisiae
taggtgtgac

SEQ ID NO: 10631 - DNA, 10 bp, Saccharomyces cerevisiae
taggtgttcc

SEQ ID NO: 10632 - DNA, 10 bp, Saccharomyces cerevisiae
tagtaaagaa

SEQ ID NO: 10633 - DNA, 10 bp, Saccharomyces cerevisiae
tagtaaatgt

SEQ ID NO: 10634 - DNA, 10 bp, Saccharomyces cerevisiae
tagtaacaag

SEQ ID NO: 10635 - DNA, 10 bp, Saccharomyces cerevisiae
tagtaatata

SEQ ID NO: 10636 - DNA, 10 bp, Saccharomyces cerevisiae
tagtaatctc

SEQ ID NO: 10637 - DNA, 10 bp, Saccharomyces cerevisiae
tagtacgaaa

SEQ ID NO: 10638 - DNA, 10 bp, Saccharomyces cerevisiae
tagtactgtt

SEQ ID NO: 10639 - DNA, 10 bp, Saccharomyces cerevisiae
tagtaggtgc

SEQ ID NO: 10640 - DNA, 10 bp, Saccharomyces cerevisiae
tagtcaggaa

SEQ ID NO: 10641 - DNA, 10 bp, Saccharomyces cerevisiae
tagtcggagt

SEQ ID NO: 10642 - DNA, 10 bp, Saccharomyces cerevisiae
tagtcttttg

SEQ ID NO: 10643 - DNA, 10 bp, Saccharomyces cerevisiae
tagtgaagtc

SEQ ID NO: 10644 - DNA, 10 bp, Saccharomyces cerevisiae
tagtgagtgg

SEQ ID NO: 10645 - DNA, 10 bp, Saccharomyces cerevisiae
tagtgtaagt

SEQ ID NO: 10646 - DNA, 10 bp, Saccharomyces cerevisiae
tagtgtaata

SEQ ID NO: 10647 - DNA, 10 bp, Saccharomyces cerevisiae
tagttgaccg

SEQ ID NO: 10648 - DNA, 10 bp, Saccharomyces cerevisiae
tagtttaatt

SEQ ID NO: 10649 - DNA, 10 bp, Saccharomyces cerevisiae
tagtttctaa

SEQ ID NO: 10650 - DNA, 10 bp, Saccharomyces cerevisiae
tagtttctgt

SEQ ID NO: 10651 - DNA, 10 bp, Saccharomyces cerevisiae
tagttttgga

SEQ ID NO: 10652 - DNA, 10 bp, Saccharomyces cerevisiae
tataaaaaaa

SEQ ID NO: 10653 - DNA, 10 bp, Saccharomyces cerevisiae
tataaaacac

SEQ ID NO: 10654 - DNA, 10 bp, Saccharomyces cerevisiae
tataaaagaa

SEQ ID NO: 10655 - DNA, 10 bp, Saccharomyces cerevisiae
tataaagcac

SEQ ID NO: 10656 - DNA, 10 bp, Saccharomyces cerevisiae
tataacggga

SEQ ID NO: 10657 - DNA, 10 bp, Saccharomyces cerevisiae
tataacgtgt

SEQ ID NO: 10658 - DNA, 10 bp, Saccharomyces cerevisiae
tataacttca

SEQ ID NO: 10659 - DNA, 10 bp, Saccharomyces cerevisiae
tataagacta

SEQ ID NO: 10660 - DNA, 10 bp, Saccharomyces cerevisiae
tataaggcgt

SEQ ID NO: 10661 - DNA, 10 bp, Saccharomyces cerevisiae
tataaggtcc

SEQ ID NO: 10662 - DNA, 10 bp, Saccharomyces cerevisiae
tataagtttt

SEQ ID NO: 10663 - DNA, 10 bp, Saccharomyces cerevisiae
tataataaat

SEQ ID NO: 10664 - DNA, 10 bp, Saccharomyces cerevisiae
tataataagt

SEQ ID NO: 10665 - DNA, 10 bp, Saccharomyces cerevisiae
tataattata

SEQ ID NO: 10666 - DNA, 10 bp, Saccharomyces cerevisiae
tatacaaaat

SEQ ID NO: 10667 - DNA, 10 bp, Saccharomyces cerevisiae
tatacaagct

SEQ ID NO: 10668 - DNA, 10 bp, Saccharomyces cerevisiae
tataccacct

SEQ ID NO: 10669 - DNA, 10 bp, Saccharomyces cerevisiae
tataccttgg

SEQ ID NO: 10670 - DNA, 10 bp, Saccharomyces cerevisiae
tatacgatac

SEQ ID NO: 10671 - DNA, 10 bp, Saccharomyces cerevisiae
tatactaatg

SEQ ID NO: 10672 - DNA, 10 bp, Saccharomyces cerevisiae
tatactacgc

SEQ ID NO: 10673 - DNA, 10 bp, Saccharomyces cerevisiae
tatactggtt

SEQ ID NO: 10674 - DNA, 10 bp, Saccharomyces cerevisiae
tatactgtat

SEQ ID NO: 10675 - DNA, 10 bp, Saccharomyces cerevisiae
tatacttaac

SEQ ID NO: 10676 - DNA, 10 bp, Saccharomyces cerevisiae
tatagaattg

SEQ ID NO: 10677 - DNA, 10 bp, Saccharomyces cerevisiae
tatagacctt

SEQ ID NO: 10678 - DNA, 10 bp, Saccharomyces cerevisiae
tatagaggaa

SEQ ID NO: 10679 - DNA, 10 bp, Saccharomyces cerevisiae
tatagattca

SEQ ID NO: 10680 - DNA, 10 bp, Saccharomyces cerevisiae
tatagcataa

SEQ ID NO: 10681 - DNA, 10 bp, Saccharomyces cerevisiae
tatagctgtt

SEQ ID NO: 10682 - DNA, 10 bp, Saccharomyces cerevisiae
tataggtcat

SEQ ID NO: 10683 - DNA, 10 bp, Saccharomyces cerevisiae
tatataacct

SEQ ID NO: 10684 - DNA, 10 bp, Saccharomyces cerevisiae
tatataatag

SEQ ID NO: 10685 - DNA, 10 bp, Saccharomyces cerevisiae
tatatataaa

SEQ ID NO: 10686 - DNA, 10 bp, Saccharomyces cerevisiae
tatatatatg

SEQ ID NO: 10687 - DNA, 10 bp, Saccharomyces cerevisiae
tatatatgat

SEQ ID NO: 10688 - DNA, 10 bp, Saccharomyces cerevisiae
tatatatgtg

SEQ ID NO: 10689 - DNA, 10 bp, Saccharomyces cerevisiae
tatatctata

SEQ ID NO: 10690 - DNA, 10 bp, Saccharomyces cerevisiae
tatatctttc

SEQ ID NO: 10691 - DNA, 10 bp, Saccharomyces cerevisiae
tatatgtatg

SEQ ID NO: 10692 - DNA, 10 bp, Saccharomyces cerevisiae
tatatgttta

SEQ ID NO: 10693 - DNA, 10 bp, Saccharomyces cerevisiae
tatattaata

SEQ ID NO: 10694 - DNA, 10 bp, Saccharomyces cerevisiae
tatattacac

SEQ ID NO: 10695 - DNA, 10 bp, Saccharomyces cerevisiae
tatattagtt

SEQ ID NO: 10696 - DNA, 10 bp, Saccharomyces cerevisiae
tatattatca

SEQ ID NO: 10697 - DNA, 10 bp, Saccharomyces cerevisiae
tatattatta

SEQ ID NO: 10698 - DNA, 10 bp, Saccharomyces cerevisiae
tatattattg

SEQ ID NO: 10699 - DNA, 10 bp, Saccharomyces cerevisiae
tatattcccg

SEQ ID NO: 10700 - DNA, 10 bp, Saccharomyces cerevisiae
tatattcctt

SEQ ID NO: 10701 - DNA, 10 bp, Saccharomyces cerevisiae
tatatttctt

SEQ ID NO: 10702 - DNA, 10 bp, Saccharomyces cerevisiae
tatcaaaaaa

SEQ ID NO: 10703 - DNA, 10 bp, Saccharomyces cerevisiae
tatcaagtgg

SEQ ID NO: 10704 - DNA, 10 bp, Saccharomyces cerevisiae
tatcaattgt

SEQ ID NO: 10705 - DNA, 10 bp, Saccharomyces cerevisiae
tatcacatta

SEQ ID NO: 10706 - DNA, 10 bp, Saccharomyces cerevisiae
tatccagttt

SEQ ID NO: 10707 - DNA, 10 bp, Saccharomyces cerevisiae
tatccatata

SEQ ID NO: 10708 - DNA, 10 bp, Saccharomyces cerevisiae
tatccattga

SEQ ID NO: 10709 - DNA, 10 bp, Saccharomyces cerevisiae
tatcctctgg

SEQ ID NO: 10710 - DNA, 10 bp, Saccharomyces cerevisiae
tatccttctc

SEQ ID NO: 10711 - DNA, 10 bp, Saccharomyces cerevisiae
tatcgactgc

SEQ ID NO: 10712 - DNA, 10 bp, Saccharomyces cerevisiae
tatcgagggt

SEQ ID NO: 10713 - DNA, 10 bp, Saccharomyces cerevisiae
tatcggccac

SEQ ID NO: 10714 - DNA, 10 bp, Saccharomyces cerevisiae
tatctaaaaa

SEQ ID NO: 10715 - DNA, 10 bp, Saccharomyces cerevisiae
tatctaccaa

SEQ ID NO: 10716 - DNA, 10 bp, Saccharomyces cerevisiae
tatctatttg

SEQ ID NO: 10717 - DNA, 10 bp, Saccharomyces cerevisiae
tatctcagat

SEQ ID NO: 10718 - DNA, 10 bp, Saccharomyces cerevisiae
tatctgaaag

SEQ ID NO: 10719 - DNA, 10 bp, Saccharomyces cerevisiae
tatctggacc

SEQ ID NO: 10720 - DNA, 10 bp, Saccharomyces cerevisiae
tatcttctaa

SEQ ID NO: 10721 - DNA, 10 bp, Saccharomyces cerevisiae
tatcttgctg

SEQ ID NO: 10722 - DNA, 10 bp, Saccharomyces cerevisiae
tatctttgca

SEQ ID NO: 10723 - DNA, 10 bp, Saccharomyces cerevisiae
tatcttttct

SEQ ID NO: 10724 - DNA, 10 bp, Saccharomyces cerevisiae
tatctttttt

SEQ ID NO: 10725 - DNA, 10 bp, Saccharomyces cerevisiae
tatgaaaaaa

SEQ ID NO: 10726 - DNA, 10 bp, Saccharomyces cerevisiae
tatgaaactt

SEQ ID NO: 10727 - DNA, 10 bp, Saccharomyces cerevisiae
tatgaaatta

SEQ ID NO: 10728 - DNA, 10 bp, Saccharomyces cerevisiae
tatgaacgta

SEQ ID NO: 10729 - DNA, 10 bp, Saccharomyces cerevisiae
tatgaagggc

SEQ ID NO: 10730 - DNA, 10 bp, Saccharomyces cerevisiae
tatgaatgct

SEQ ID NO: 10731 - DNA, 10 bp, Saccharomyces cerevisiae
tatgaatgta

SEQ ID NO: 10732 - DNA, 10 bp, Saccharomyces cerevisiae
tatgaattat

SEQ ID NO: 10733 - DNA, 10 bp, Saccharomyces cerevisiae
tatgaccagt

SEQ ID NO: 10734 - DNA, 10 bp, Saccharomyces cerevisiae
tatgaccttt

SEQ ID NO: 10735 - DNA, 10 bp, Saccharomyces cerevisiae
tatgacgtat

SEQ ID NO: 10736 - DNA, 10 bp, Saccharomyces cerevisiae
tatgagagta

SEQ ID NO: 10737 - DNA, 10 bp, Saccharomyces cerevisiae
tatgaggtca

SEQ ID NO: 10738 - DNA, 10 bp, Saccharomyces cerevisiae
tatgatgcag

SEQ ID NO: 10739 - DNA, 10 bp, Saccharomyces cerevisiae
tatgattcta

SEQ ID NO: 10740 - DNA, 10 bp, Saccharomyces cerevisiae
tatgcaccta

SEQ ID NO: 10741 - DNA, 10 bp, Saccharomyces cerevisiae
tatgcattta

SEQ ID NO: 10742 - DNA, 10 bp, Saccharomyces cerevisiae
tatgcctgct

SEQ ID NO: 10743 - DNA, 10 bp, Saccharomyces cerevisiae
tatgcctgga

SEQ ID NO: 10744 - DNA, 10 bp, Saccharomyces cerevisiae
tatgcgggct

SEQ ID NO: 10745 - DNA, 10 bp, Saccharomyces cerevisiae
tatggaaata

SEQ ID NO: 10746 - DNA, 10 bp, Saccharomyces cerevisiae
tatggacccc

SEQ ID NO: 10747 - DNA, 10 bp, Saccharomyces cerevisiae
tatggatcaa

SEQ ID NO: 10748 - DNA, 10 bp, Saccharomyces cerevisiae
tatggatctg

SEQ ID NO: 10749 - DNA, 10 bp, Saccharomyces cerevisiae
tatgggcggg

SEQ ID NO: 10750 - DNA, 10 bp, Saccharomyces cerevisiae
tatggtaccg

SEQ ID NO: 10751 - DNA, 10 bp, Saccharomyces cerevisiae
tatgtaataa

SEQ ID NO: 10752 - DNA, 10 bp, Saccharomyces cerevisiae
tatgtaatta

SEQ ID NO: 10753 - DNA, 10 bp, Saccharomyces cerevisiae
tatgtacgta

SEQ ID NO: 10754 - DNA, 10 bp, Saccharomyces cerevisiae
tatgtatacc

SEQ ID NO: 10755 - DNA, 10 bp, Saccharomyces cerevisiae
tatgtatcat

SEQ ID NO: 10756 - DNA, 10 bp, Saccharomyces cerevisiae
tatgtattct

SEQ ID NO: 10757 - DNA, 10 bp, Saccharomyces cerevisiae
tatgtatttt

SEQ ID NO: 10758 - DNA, 10 bp, Saccharomyces cerevisiae
tatgtcgaaa

SEQ ID NO: 10759 - DNA, 10 bp, Saccharomyces cerevisiae
tatgtgataa

SEQ ID NO: 10760 - DNA, 10 bp, Saccharomyces cerevisiae
tatgtggtac

SEQ ID NO: 10761 - DNA, 10 bp, Saccharomyces cerevisiae
tatgtgtaga

SEQ ID NO: 10762 - DNA, 10 bp, Saccharomyces cerevisiae
tatgtgtata

SEQ ID NO: 10763 - DNA, 10 bp, Saccharomyces cerevisiae
tatgttaaaa

SEQ ID NO: 10764 - DNA, 10 bp, Saccharomyces cerevisiae
tatgttatgt

SEQ ID NO: 10765 - DNA, 10 bp, Saccharomyces cerevisiae
tattaaagga

SEQ ID NO: 10766 - DNA, 10 bp, Saccharomyces cerevisiae
tattaagatt

SEQ ID NO: 10767 - DNA, 10 bp, Saccharomyces cerevisiae
tattagtatt

SEQ ID NO: 10768 - DNA, 10 bp, Saccharomyces cerevisiae
tattattatc

SEQ ID NO: 10769 - DNA, 10 bp, Saccharomyces cerevisiae
tattcaattg

SEQ ID NO: 10770 - DNA, 10 bp, Saccharomyces cerevisiae
tattcagggt

SEQ ID NO: 10771 - DNA, 10 bp, Saccharomyces cerevisiae
tattccgaaa

SEQ ID NO: 10772 - DNA, 10 bp, Saccharomyces cerevisiae
tattcggaag

SEQ ID NO: 10773 - DNA, 10 bp, Saccharomyces cerevisiae
tattcgggat

SEQ ID NO: 10774 - DNA, 10 bp, Saccharomyces cerevisiae
tattctccgc

SEQ ID NO: 10775 - DNA, 10 bp, Saccharomyces cerevisiae
tattctgttt

SEQ ID NO: 10776 - DNA, 10 bp, Saccharomyces cerevisiae
tattcttatt

SEQ ID NO: 10777 - DNA, 10 bp, Saccharomyces cerevisiae
tattgcaaat

SEQ ID NO: 10778 - DNA, 10 bp, Saccharomyces cerevisiae
tattgcaacc

SEQ ID NO: 10779 - DNA, 10 bp, Saccharomyces cerevisiae
tattggaaca

SEQ ID NO: 10780 - DNA, 10 bp, Saccharomyces cerevisiae
tattggactt

SEQ ID NO: 10781 - DNA, 10 bp, Saccharomyces cerevisiae
tattggcaat

SEQ ID NO: 10782 - DNA, 10 bp, Saccharomyces cerevisiae
tattgggaga

SEQ ID NO: 10783 - DNA, 10 bp, Saccharomyces cerevisiae
tattggtact

SEQ ID NO: 10784 - DNA, 10 bp, Saccharomyces cerevisiae
tattggtagg

SEQ ID NO: 10785 - DNA, 10 bp, Saccharomyces cerevisiae
tattgtagtt

SEQ ID NO: 10786 - DNA, 10 bp, Saccharomyces cerevisiae
tattgtgtgc

SEQ ID NO: 10787 - DNA, 10 bp, Saccharomyces cerevisiae
tatttaaaaa

SEQ ID NO: 10788 - DNA, 10 bp, Saccharomyces cerevisiae
tatttacctc

SEQ ID NO: 10789 - DNA, 10 bp, Saccharomyces cerevisiae
tatttattaa

SEQ ID NO: 10790 - DNA, 10 bp, Saccharomyces cerevisiae
tatttcaatt

SEQ ID NO: 10791 - DNA, 10 bp, Saccharomyces cerevisiae
tatttcttgg

SEQ ID NO: 10792 - DNA, 10 bp, Saccharomyces cerevisiae
tattttcata

SEQ ID NO: 10793 - DNA, 10 bp, Saccharomyces cerevisiae
tattttccca

SEQ ID NO: 10794 - DNA, 10 bp, Saccharomyces cerevisiae
tatttttaaa

SEQ ID NO: 10795 - DNA, 10 bp, Saccharomyces cerevisiae
tatttttgaa

SEQ ID NO: 10796 - DNA, 10 bp, Saccharomyces cerevisiae
tattttttaa

SEQ ID NO: 10797 - DNA, 10 bp, Saccharomyces cerevisiae
tcaaaaatgg

SEQ ID NO: 10798 - DNA, 10 bp, Saccharomyces cerevisiae
tcaaaagctg

SEQ ID NO: 10799 - DNA, 10 bp, Saccharomyces cerevisiae
tcaaaattgc

SEQ ID NO: 10800 - DNA, 10 bp, Saccharomyces cerevisiae
tcaaacaaaa

SEQ ID NO: 10801 - DNA, 10 bp, Saccharomyces cerevisiae
tcaaaccgct

SEQ ID NO: 10802 - DNA, 10 bp, Saccharomyces cerevisiae
tcaaagcact

SEQ ID NO: 10803 - DNA, 10 bp, Saccharomyces cerevisiae
tcaaagcatt

SEQ ID NO: 10804 - DNA, 10 bp, Saccharomyces cerevisiae
tcaaagccgt

SEQ ID NO: 10805 - DNA, 10 bp, Saccharomyces cerevisiae
tcaaatagag

SEQ ID NO: 10806 - DNA, 10 bp, Saccharomyces cerevisiae
tcaaatccaa

SEQ ID NO: 10807 - DNA, 10 bp, Saccharomyces cerevisiae
tcaaatctta

SEQ ID NO: 10808 - DNA, 10 bp, Saccharomyces cerevisiae
tcaaattaac

SEQ ID NO: 10809 - DNA, 10 bp, Saccharomyces cerevisiae
tcaacaaaag

SEQ ID NO: 10810 - DNA, 10 bp, Saccharomyces cerevisiae
tcaacatcag

SEQ ID NO: 10811 - DNA, 10 bp, Saccharomyces cerevisiae
tcaacatcct

SEQ ID NO: 10812 - DNA, 10 bp, Saccharomyces cerevisiae
tcaaccgtgg

SEQ ID NO: 10813 - DNA, 10 bp, Saccharomyces cerevisiae
tcaactggat

SEQ ID NO: 10814 - DNA, 10 bp, Saccharomyces cerevisiae
tcaacttact

SEQ ID NO: 10815 - DNA, 10 bp, Saccharomyces cerevisiae
tcaactttaa

SEQ ID NO: 10816 - DNA, 10 bp, Saccharomyces cerevisiae
tcaagaaagt

SEQ ID NO: 10817 - DNA, 10 bp, Saccharomyces cerevisiae
tcaagaacgg

SEQ ID NO: 10818 - DNA, 10 bp, Saccharomyces cerevisiae
tcaagaagta

SEQ ID NO: 10819 - DNA, 10 bp, Saccharomyces cerevisiae
tcaagattgt

SEQ ID NO: 10820 - DNA, 10 bp, Saccharomyces cerevisiae
tcaagcacct

SEQ ID NO: 10821 - DNA, 10 bp, Saccharomyces cerevisiae
tcaagccctc

SEQ ID NO: 10822 - DNA, 10 bp, Saccharomyces cerevisiae
tcaagcttgt

SEQ ID NO: 10823 - DNA, 10 bp, Saccharomyces cerevisiae
tcaaggagta

SEQ ID NO: 10824 - DNA, 10 bp, Saccharomyces cerevisiae
tcaaggccgg

SEQ ID NO: 10825 - DNA, 10 bp, Saccharomyces cerevisiae
tcaagtagca

SEQ ID NO: 10826 - DNA, 10 bp, Saccharomyces cerevisiae
tcaatagagg

SEQ ID NO: 10827 - DNA, 10 bp, Saccharomyces cerevisiae
tcaatcagtt

SEQ ID NO: 10828 - DNA, 10 bp, Saccharomyces cerevisiae
tcaatcatat

SEQ ID NO: 10829 - DNA, 10 bp, Saccharomyces cerevisiae
tcaatcttgc

SEQ ID NO: 10830 - DNA, 10 bp, Saccharomyces cerevisiae
tcaatctttg

SEQ ID NO: 10831 - DNA, 10 bp, Saccharomyces cerevisiae
tcaatgcaca

SEQ ID NO: 10832 - DNA, 10 bp, Saccharomyces cerevisiae
tcaattaatg

SEQ ID NO: 10833 - DNA, 10 bp, Saccharomyces cerevisiae
tcaattcctt

SEQ ID NO: 10834 - DNA, 10 bp, Saccharomyces cerevisiae
tcaattcgaa

SEQ ID NO: 10835 - DNA, 10 bp, Saccharomyces cerevisiae
tcaattctgt

SEQ ID NO: 10836 - DNA, 10 bp, Saccharomyces cerevisiae
tcacaacacc

SEQ ID NO: 10837 - DNA, 10 bp, Saccharomyces cerevisiae
tcacaattta

SEQ ID NO: 10838 - DNA, 10 bp, Saccharomyces cerevisiae
tcaccagagt

SEQ ID NO: 10839 - DNA, 10 bp, Saccharomyces cerevisiae
tcacccgtac

SEQ ID NO: 10840 - DNA, 10 bp, Saccharomyces cerevisiae
tcaccgcatc

SEQ ID NO: 10841 - DNA, 10 bp, Saccharomyces cerevisiae
tcaccggggc

SEQ ID NO: 10842 - DNA, 10 bp, Saccharomyces cerevisiae
tcaccgtaca

SEQ ID NO: 10843 - DNA, 10 bp, Saccharomyces cerevisiae
tcaccttgca

SEQ ID NO: 10844 - DNA, 10 bp, Saccharomyces cerevisiae
tcacgattta

SEQ ID NO: 10845 - DNA, 10 bp, Saccharomyces cerevisiae
tcacggccaa

SEQ ID NO: 10846 - DNA, 10 bp, Saccharomyces cerevisiae
tcacgggtac

SEQ ID NO: 10847 - DNA, 10 bp, Saccharomyces cerevisiae
tcactcgcca

SEQ ID NO: 10848 - DNA, 10 bp, Saccharomyces cerevisiae
tcactctgct

SEQ ID NO: 10849 - DNA, 10 bp, Saccharomyces cerevisiae
tcactgacgc

SEQ ID NO: 10850 - DNA, 10 bp, Saccharomyces cerevisiae
tcactggcct

SEQ ID NO: 10851 - DNA, 10 bp, Saccharomyces cerevisiae
tcacttcatt

SEQ ID NO: 10852 - DNA, 10 bp, Saccharomyces cerevisiae
tcacttccgc

SEQ ID NO: 10853 - DNA, 10 bp, Saccharomyces cerevisiae
tcacttgagg

SEQ ID NO: 10854 - DNA, 10 bp, Saccharomyces cerevisiae
tcacttgttc

SEQ ID NO: 10855 - DNA, 10 bp, Saccharomyces cerevisiae
tcactttgaa

SEQ ID NO: 10856 - DNA, 10 bp, Saccharomyces cerevisiae
tcagaaacgc

SEQ ID NO: 10857 - DNA, 10 bp, Saccharomyces cerevisiae
tcagaaagca

SEQ ID NO: 10858 - DNA, 10 bp, Saccharomyces cerevisiae
tcagaagagt

SEQ ID NO: 10859 - DNA, 10 bp, Saccharomyces cerevisiae
tcagaagtgg

SEQ ID NO: 10860 - DNA, 10 bp, Saccharomyces cerevisiae
tcagaatata

SEQ ID NO: 10861 - DNA, 10 bp, Saccharomyces cerevisiae
tcagaatctt

SEQ ID NO: 10862 - DNA, 10 bp, Saccharomyces cerevisiae
tcagagacag

SEQ ID NO: 10863 - DNA, 10 bp, Saccharomyces cerevisiae
tcagagataa

SEQ ID NO: 10864 - DNA, 10 bp, Saccharomyces cerevisiae
tcagaggaaa

SEQ ID NO: 10865 - DNA, 10 bp, Saccharomyces cerevisiae
tcagatatga

SEQ ID NO: 10866 - DNA, 10 bp, Saccharomyces cerevisiae
tcagatgttg

SEQ ID NO: 10867 - DNA, 10 bp, Saccharomyces cerevisiae
tcagattgga

SEQ ID NO: 10868 - DNA, 10 bp, Saccharomyces cerevisiae
tcagatttct

SEQ ID NO: 10869 - DNA, 10 bp, Saccharomyces cerevisiae
tcagcaaaag

SEQ ID NO: 10870 - DNA, 10 bp, Saccharomyces cerevisiae
tcagcaataa

SEQ ID NO: 10871 - DNA, 10 bp, Saccharomyces cerevisiae
tcagcctgca

SEQ ID NO: 10872 - DNA, 10 bp, Saccharomyces cerevisiae
tcagcgtatg

SEQ ID NO: 10873 - DNA, 10 bp, Saccharomyces cerevisiae
tcaggatcga

SEQ ID NO: 10874 - DNA, 10 bp, Saccharomyces cerevisiae
tcagggactc

SEQ ID NO: 10875 - DNA, 10 bp, Saccharomyces cerevisiae
tcaggtgctg

SEQ ID NO: 10876 - DNA, 10 bp, Saccharomyces cerevisiae
tcagtaaccc

SEQ ID NO: 10877 - DNA, 10 bp, Saccharomyces cerevisiae
tcagtaagcc

SEQ ID NO: 10878 - DNA, 10 bp, Saccharomyces cerevisiae
tcagtagaac

SEQ ID NO: 10879 - DNA, 10 bp, Saccharomyces cerevisiae
tcagtattcc

SEQ ID NO: 10880 - DNA, 10 bp, Saccharomyces cerevisiae
tcagtcgcaa

SEQ ID NO: 10881 - DNA, 10 bp, Saccharomyces cerevisiae
tcagtgtatc

SEQ ID NO: 10882 - DNA, 10 bp, Saccharomyces cerevisiae
tcataactga

SEQ ID NO: 10883 - DNA, 10 bp, Saccharomyces cerevisiae
tcataatctt

SEQ ID NO: 10884 - DNA, 10 bp, Saccharomyces cerevisiae
tcatagaatt

SEQ ID NO: 10885 - DNA, 10 bp, Saccharomyces cerevisiae
tcatagcact

SEQ ID NO: 10886 - DNA, 10 bp, Saccharomyces cerevisiae
tcatcaaaaa

SEQ ID NO: 10887 - DNA, 10 bp, Saccharomyces cerevisiae
tcatcaatga

SEQ ID NO: 10888 - DNA, 10 bp, Saccharomyces cerevisiae
tcatcaccga

SEQ ID NO: 10889 - DNA, 10 bp, Saccharomyces cerevisiae
tcatcaccta

SEQ ID NO: 10890 - DNA, 10 bp, Saccharomyces cerevisiae
tcatccagat

SEQ ID NO: 10891 - DNA, 10 bp, Saccharomyces cerevisiae
tcatcgaaaa

SEQ ID NO: 10892 - DNA, 10 bp, Saccharomyces cerevisiae
tcatcggaag

SEQ ID NO: 10893 - DNA, 10 bp, Saccharomyces cerevisiae
tcatcgtagt

SEQ ID NO: 10894 - DNA, 10 bp, Saccharomyces cerevisiae
tcatcgtatg

SEQ ID NO: 10895 - DNA, 10 bp, Saccharomyces cerevisiae
tcatcgtcag

SEQ ID NO: 10896 - DNA, 10 bp, Saccharomyces cerevisiae
tcatcgtcat

SEQ ID NO: 10897 - DNA, 10 bp, Saccharomyces cerevisiae
tcatctacat

SEQ ID NO: 10898 - DNA, 10 bp, Saccharomyces cerevisiae
tcatctgtga

SEQ ID NO: 10899 - DNA, 10 bp, Saccharomyces cerevisiae
tcatctgttt

SEQ ID NO: 10900 - DNA, 10 bp, Saccharomyces cerevisiae
tcatcttaca

SEQ ID NO: 10901 - DNA, 10 bp, Saccharomyces cerevisiae
tcatcttctt

SEQ ID NO: 10902 - DNA, 10 bp, Saccharomyces cerevisiae
tcatctttac

SEQ ID NO: 10903 - DNA, 10 bp, Saccharomyces cerevisiae
tcattaaaca

SEQ ID NO: 10904 - DNA, 10 bp, Saccharomyces cerevisiae
tcattcaaaa

SEQ ID NO: 10905 - DNA, 10 bp, Saccharomyces cerevisiae
tcattcaacg

SEQ ID NO: 10906 - DNA, 10 bp, Saccharomyces cerevisiae
tcattcagta

SEQ ID NO: 10907 - DNA, 10 bp, Saccharomyces cerevisiae
tcattgagaa

SEQ ID NO: 10908 - DNA, 10 bp, Saccharomyces cerevisiae
tcatttcgaa

SEQ ID NO: 10909 - DNA, 10 bp, Saccharomyces cerevisiae
tcattttata

SEQ ID NO: 10910 - DNA, 10 bp, Saccharomyces cerevisiae
tccaaaaaaa

SEQ ID NO: 10911 - DNA, 10 bp, Saccharomyces cerevisiae
tccaaaaggc

SEQ ID NO: 10912 - DNA, 10 bp, Saccharomyces cerevisiae
tccaaaggca

SEQ ID NO: 10913 - DNA, 10 bp, Saccharomyces cerevisiae
tccaaaggcc

SEQ ID NO: 10914 - DNA, 10 bp, Saccharomyces cerevisiae
tccaaagtgc

SEQ ID NO: 10915 - DNA, 10 bp, Saccharomyces cerevisiae
tccaactacc

SEQ ID NO: 10916 - DNA, 10 bp, Saccharomyces cerevisiae
tccaagcaat

SEQ ID NO: 10917 - DNA, 10 bp, Saccharomyces cerevisiae
tccaagcatt

SEQ ID NO: 10918 - DNA, 10 bp, Saccharomyces cerevisiae
tccaaggagg

SEQ ID NO: 10919 - DNA, 10 bp, Saccharomyces cerevisiae
tccaagtacg

SEQ ID NO: 10920 - DNA, 10 bp, Saccharomyces cerevisiae
tccaagtccg

SEQ ID NO: 10921 - DNA, 10 bp, Saccharomyces cerevisiae
tccaattgtc

SEQ ID NO: 10922 - DNA, 10 bp, Saccharomyces cerevisiae
tccaatttat

SEQ ID NO: 10923 - DNA, 10 bp, Saccharomyces cerevisiae
tccacaatat

SEQ ID NO: 10924 - DNA, 10 bp, Saccharomyces cerevisiae
tccacaattt

SEQ ID NO: 10925 - DNA, 10 bp, Saccharomyces cerevisiae
tccacatttt

SEQ ID NO: 10926 - DNA, 10 bp, Saccharomyces cerevisiae
tccaccaagc

SEQ ID NO: 10927 - DNA, 10 bp, Saccharomyces cerevisiae
tccacggttc

SEQ ID NO: 10928 - DNA, 10 bp, Saccharomyces cerevisiae
tccactaatc

SEQ ID NO: 10929 - DNA, 10 bp, Saccharomyces cerevisiae
tccactagtc

SEQ ID NO: 10930 - DNA, 10 bp, Saccharomyces cerevisiae
tccacttgag

SEQ ID NO: 10931 - DNA, 10 bp, Saccharomyces cerevisiae
tccagatcca

SEQ ID NO: 10932 - DNA, 10 bp, Saccharomyces cerevisiae
tccagccaat

SEQ ID NO: 10933 - DNA, 10 bp, Saccharomyces cerevisiae
tccagctgga

SEQ ID NO: 10934 - DNA, 10 bp, Saccharomyces cerevisiae
tccagggact

SEQ ID NO: 10935 - DNA, 10 bp, Saccharomyces cerevisiae
tccagtgaaa

SEQ ID NO: 10936 - DNA, 10 bp, Saccharomyces cerevisiae
tccataacct

SEQ ID NO: 10937 - DNA, 10 bp, Saccharomyces cerevisiae
tccataggcg

SEQ ID NO: 10938 - DNA, 10 bp, Saccharomyces cerevisiae
tccatattaa

SEQ ID NO: 10939 - DNA, 10 bp, Saccharomyces cerevisiae
tccatcttgc

SEQ ID NO: 10940 - DNA, 10 bp, Saccharomyces cerevisiae
tccatcttgt

SEQ ID NO: 10941 - DNA, 10 bp, Saccharomyces cerevisiae
tccattaata

SEQ ID NO: 10942 - DNA, 10 bp, Saccharomyces cerevisiae
tccattacca

SEQ ID NO: 10943 - DNA, 10 bp, Saccharomyces cerevisiae
tcccactcct

SEQ ID NO: 10944 - DNA, 10 bp, Saccharomyces cerevisiae
tcccagttcg

SEQ ID NO: 10945 - DNA, 10 bp, Saccharomyces cerevisiae
tccccaatta

SEQ ID NO: 10946 - DNA, 10 bp, Saccharomyces cerevisiae
tccccagaag

SEQ ID NO: 10947 - DNA, 10 bp, Saccharomyces cerevisiae
tccccagagg

SEQ ID NO: 10948 - DNA, 10 bp, Saccharomyces cerevisiae
tcccccgtaa

SEQ ID NO: 10949 - DNA, 10 bp, Saccharomyces cerevisiae
tccccctaca

SEQ ID NO: 10950 - DNA, 10 bp, Saccharomyces cerevisiae
tccccgatac

SEQ ID NO: 10951 - DNA, 10 bp, Saccharomyces cerevisiae
tccccgatcg

SEQ ID NO: 10952 - DNA, 10 bp, Saccharomyces cerevisiae
tccccgatgg

SEQ ID NO: 10953 - DNA, 10 bp, Saccharomyces cerevisiae
tccccggaca

SEQ ID NO: 10954 - DNA, 10 bp, Saccharomyces cerevisiae
tccccgtaac

SEQ ID NO: 10955 - DNA, 10 bp, Saccharomyces cerevisiae
tccccgtaag

SEQ ID NO: 10956 - DNA, 10 bp, Saccharomyces cerevisiae
tccccgtagt

SEQ ID NO: 10957 - DNA, 10 bp, Saccharomyces cerevisiae
tccccgtcac

SEQ ID NO: 10958 - DNA, 10 bp, Saccharomyces cerevisiae
tccccgtcgt

SEQ ID NO: 10959 - DNA, 10 bp, Saccharomyces cerevisiae
tccccgtgaa

SEQ ID NO: 10960 - DNA, 10 bp, Saccharomyces cerevisiae
tccccgtgca

SEQ ID NO: 10961 - DNA, 10 bp, Saccharomyces cerevisiae
tccccgttac

SEQ ID NO: 10962 - DNA, 10 bp, Saccharomyces cerevisiae
tccccgttag

SEQ ID NO: 10963 - DNA, 10 bp, Saccharomyces cerevisiae
tccccgttca

SEQ ID NO: 10964 - DNA, 10 bp, Saccharomyces cerevisiae
tccccgtttt

SEQ ID NO: 10965 - DNA, 10 bp, Saccharomyces cerevisiae
tcccctagaa

SEQ ID NO: 10966 - DNA, 10 bp, Saccharomyces cerevisiae
tcccctggct

SEQ ID NO: 10967 - DNA, 10 bp, Saccharomyces cerevisiae
tcccgaacat

SEQ ID NO: 10968 - DNA, 10 bp, Saccharomyces cerevisiae
tcccggacag

SEQ ID NO: 10969 - DNA, 10 bp, Saccharomyces cerevisiae
tcccgtaaaa

SEQ ID NO: 10970 - DNA, 10 bp, Saccharomyces cerevisiae
tcccgtacac

SEQ ID NO: 10971 - DNA, 10 bp, Saccharomyces cerevisiae
tcccgtatcg

SEQ ID NO: 10972 - DNA, 10 bp, Saccharomyces cerevisiae
tccctagcct

SEQ ID NO: 10973 - DNA, 10 bp, Saccharomyces cerevisiae
tccctagtaa

SEQ ID NO: 10974 - DNA, 10 bp, Saccharomyces cerevisiae
tccctataaa

SEQ ID NO: 10975 - DNA, 10 bp, Saccharomyces cerevisiae
tccctatgag

SEQ ID NO: 10976 - DNA, 10 bp, Saccharomyces cerevisiae
tccctattac

SEQ ID NO: 10977 - DNA, 10 bp, Saccharomyces cerevisiae
tccctattca

SEQ ID NO: 10978 - DNA, 10 bp, Saccharomyces cerevisiae
tccctccttg

SEQ ID NO: 10979 - DNA, 10 bp, Saccharomyces cerevisiae
tccctctttg

SEQ ID NO: 10980 - DNA, 10 bp, Saccharomyces cerevisiae
tccctgaatt

SEQ ID NO: 10981 - DNA, 10 bp, Saccharomyces cerevisiae
tccctgtggt

SEQ ID NO: 10982 - DNA, 10 bp, Saccharomyces cerevisiae
tccctttagg

SEQ ID NO: 10983 - DNA, 10 bp, Saccharomyces cerevisiae
tccgaaaacg

SEQ ID NO: 10984 - DNA, 10 bp, Saccharomyces cerevisiae
tccgaatagc

SEQ ID NO: 10985 - DNA, 10 bp, Saccharomyces cerevisiae
tccgaatccg

SEQ ID NO: 10986 - DNA, 10 bp, Saccharomyces cerevisiae
tccgagctgg

SEQ ID NO: 10987 - DNA, 10 bp, Saccharomyces cerevisiae
tccgaggtcc

SEQ ID NO: 10988 - DNA, 10 bp, Saccharomyces cerevisiae
tccgagttcg

SEQ ID NO: 10989 - DNA, 10 bp, Saccharomyces cerevisiae
tccgcagaag

SEQ ID NO: 10990 - DNA, 10 bp, Saccharomyces cerevisiae
tccgccagaa

SEQ ID NO: 10991 - DNA, 10 bp, Saccharomyces cerevisiae
tccgcgtaga

SEQ ID NO: 10992 - DNA, 10 bp, Saccharomyces cerevisiae
tccgctcaaa

SEQ ID NO: 10993 - DNA, 10 bp, Saccharomyces cerevisiae
tccgctgtct

SEQ ID NO: 10994 - DNA, 10 bp, Saccharomyces cerevisiae
tccgcttggg

SEQ ID NO: 10995 - DNA, 10 bp, Saccharomyces cerevisiae
tccggatctg

SEQ ID NO: 10996 - DNA, 10 bp, Saccharomyces cerevisiae
tccgggtccg

SEQ ID NO: 10997 - DNA, 10 bp, Saccharomyces cerevisiae
tccgtacagc

SEQ ID NO: 10998 - DNA, 10 bp, Saccharomyces cerevisiae
tccgtattaa

SEQ ID NO: 10999 - DNA, 10 bp, Saccharomyces cerevisiae
tccgtcactt

SEQ ID NO: 11000 - DNA, 10 bp, Saccharomyces cerevisiae
tccgtgggga

SEQ ID NO: 11001 - DNA, 10 bp, Saccharomyces cerevisiae
tcctacatcg

SEQ ID NO: 11002 - DNA, 10 bp, Saccharomyces cerevisiae
tcctacgatg

SEQ ID NO: 11003 - DNA, 10 bp, Saccharomyces cerevisiae
tcctactggt

SEQ ID NO: 11004 - DNA, 10 bp, Saccharomyces cerevisiae
tcctagctcg

SEQ ID NO: 11005 - DNA, 10 bp, Saccharomyces cerevisiae
tcctaggctg

SEQ ID NO: 11006 - DNA, 10 bp, Saccharomyces cerevisiae
tcctcagtct

SEQ ID NO: 11007 - DNA, 10 bp, Saccharomyces cerevisiae
tcctccatag

SEQ ID NO: 11008 - DNA, 10 bp, Saccharomyces cerevisiae
tcctcccacc

SEQ ID NO: 11009 - DNA, 10 bp, Saccharomyces cerevisiae
tcctcgacat

SEQ ID NO: 11010 - DNA, 10 bp, Saccharomyces cerevisiae
tcctcgtggg

SEQ ID NO: 11011 - DNA, 10 bp, Saccharomyces cerevisiae
tcctctccag

SEQ ID NO: 11012 - DNA, 10 bp, Saccharomyces cerevisiae
tcctgcaatg

SEQ ID NO: 11013 - DNA, 10 bp, Saccharomyces cerevisiae
tcctggtata

SEQ ID NO: 11014 - DNA, 10 bp, Saccharomyces cerevisiae
tcctgtctcc

SEQ ID NO: 11015 - DNA, 10 bp, Saccharomyces cerevisiae
tcctgtcttg

SEQ ID NO: 11016 - DNA, 10 bp, Saccharomyces cerevisiae
tccttaccca

SEQ ID NO: 11017 - DNA, 10 bp, Saccharomyces cerevisiae
tccttcaact

SEQ ID NO: 11018 - DNA, 10 bp, Saccharomyces cerevisiae
tccttcagtt

SEQ ID NO: 11019 - DNA, 10 bp, Saccharomyces cerevisiae
tccttctagc

SEQ ID NO: 11020 - DNA, 10 bp, Saccharomyces cerevisiae
tccttctggg

SEQ ID NO: 11021 - DNA, 10 bp, Saccharomyces cerevisiae
tccttgaccg

SEQ ID NO: 11022 - DNA, 10 bp, Saccharomyces cerevisiae
tccttgagaa

SEQ ID NO: 11023 - DNA, 10 bp, Saccharomyces cerevisiae
tccttgctaa

SEQ ID NO: 11024 - DNA, 10 bp, Saccharomyces cerevisiae
tccttgtatt

SEQ ID NO: 11025 - DNA, 10 bp, Saccharomyces cerevisiae
tcctttcaaa

SEQ ID NO: 11026 - DNA, 10 bp, Saccharomyces cerevisiae
tccttttcga

SEQ ID NO: 11027 - DNA, 10 bp, Saccharomyces cerevisiae
tccttttgga

SEQ ID NO: 11028 - DNA, 10 bp, Saccharomyces cerevisiae
tcgaaaaaaa

SEQ ID NO: 11029 - DNA, 10 bp, Saccharomyces cerevisiae
tcgaaacgta

SEQ ID NO: 11030 - DNA, 10 bp, Saccharomyces cerevisiae
tcgaaagaag

SEQ ID NO: 11031 - DNA, 10 bp, Saccharomyces cerevisiae
tcgaaagcta

SEQ ID NO: 11032 - DNA, 10 bp, Saccharomyces cerevisiae
tcgaactacc

SEQ ID NO: 11033 - DNA, 10 bp, Saccharomyces cerevisiae
tcgacggggc

SEQ ID NO: 11034 - DNA, 10 bp, Saccharomyces cerevisiae
tcgacgtggt

SEQ ID NO: 11035 - DNA, 10 bp, Saccharomyces cerevisiae
tcgacgttgc

SEQ ID NO: 11036 - DNA, 10 bp, Saccharomyces cerevisiae
tcgactacat

SEQ ID NO: 11037 - DNA, 10 bp, Saccharomyces cerevisiae
tcgaggtgtg

SEQ ID NO: 11038 - DNA, 10 bp, Saccharomyces cerevisiae
tcgataccgg

SEQ ID NO: 11039 - DNA, 10 bp, Saccharomyces cerevisiae
tcgatatctc

SEQ ID NO: 11040 - DNA, 10 bp, Saccharomyces cerevisiae
tcgatcatct

SEQ ID NO: 11041 - DNA, 10 bp, Saccharomyces cerevisiae
tcgatgaatt

SEQ ID NO: 11042 - DNA, 10 bp, Saccharomyces cerevisiae
tcgattaaga

SEQ ID NO: 11043 - DNA, 10 bp, Saccharomyces cerevisiae
tcgcaacaat

SEQ ID NO: 11044 - DNA, 10 bp, Saccharomyces cerevisiae
tcgcaatgtg

SEQ ID NO: 11045 - DNA, 10 bp, Saccharomyces cerevisiae
tcgcaggtaa

SEQ ID NO: 11046 - DNA, 10 bp, Saccharomyces cerevisiae
tcgcatttgt

SEQ ID NO: 11047 - DNA, 10 bp, Saccharomyces cerevisiae
tcgccattaa

SEQ ID NO: 11048 - DNA, 10 bp, Saccharomyces cerevisiae
tcgccctttg

SEQ ID NO: 11049 - DNA, 10 bp, Saccharomyces cerevisiae
tcgccgctca

SEQ ID NO: 11050 - DNA, 10 bp, Saccharomyces cerevisiae
tcgccgtaca

SEQ ID NO: 11051 - DNA, 10 bp, Saccharomyces cerevisiae
tcgcctgttt

SEQ ID NO: 11052 - DNA, 10 bp, Saccharomyces cerevisiae
tcgcctttaa

SEQ ID NO: 11053 - DNA, 10 bp, Saccharomyces cerevisiae
tcgccttttt

SEQ ID NO: 11054 - DNA, 10 bp, Saccharomyces cerevisiae
tcgcgatgag

SEQ ID NO: 11055 - DNA, 10 bp, Saccharomyces cerevisiae
tcgcgtgaaa

SEQ ID NO: 11056 - DNA, 10 bp, Saccharomyces cerevisiae
tcgctcattt

SEQ ID NO: 11057 - DNA, 10 bp, Saccharomyces cerevisiae
tcgctgccga

SEQ ID NO: 11058 - DNA, 10 bp, Saccharomyces cerevisiae
tcgctgggca

SEQ ID NO: 11059 - DNA, 10 bp, Saccharomyces cerevisiae
tcgctgtttc

SEQ ID NO: 11060 - DNA, 10 bp, Saccharomyces cerevisiae
tcgcttaaat

SEQ ID NO: 11061 - DNA, 10 bp, Saccharomyces cerevisiae
tcgcttcatc

SEQ ID NO: 11062 - DNA, 10 bp, Saccharomyces cerevisiae
tcggaaacaa

SEQ ID NO: 11063 - DNA, 10 bp, Saccharomyces cerevisiae
tcggacagaa

SEQ ID NO: 11064 - DNA, 10 bp, Saccharomyces cerevisiae
tcggagatgg

SEQ ID NO: 11065 - DNA, 10 bp, Saccharomyces cerevisiae
tcggatccta

SEQ ID NO: 11066 - DNA, 10 bp, Saccharomyces cerevisiae
tcggcattaa

SEQ ID NO: 11067 - DNA, 10 bp, Saccharomyces cerevisiae
tcggcgaatg

SEQ ID NO: 11068 - DNA, 10 bp, Saccharomyces cerevisiae
tcggcgagag

SEQ ID NO: 11069 - DNA, 10 bp, Saccharomyces cerevisiae
tcggcgctct

SEQ ID NO: 11070 - DNA, 10 bp, Saccharomyces cerevisiae
tcggcgtggc

SEQ ID NO: 11071 - DNA, 10 bp, Saccharomyces cerevisiae
tcgggaaaat

SEQ ID NO: 11072 - DNA, 10 bp, Saccharomyces cerevisiae
tcgggcattg

SEQ ID NO: 11073 - DNA, 10 bp, Saccharomyces cerevisiae
tcgggctagt

SEQ ID NO: 11074 - DNA, 10 bp, Saccharomyces cerevisiae
tcggggacgg

SEQ ID NO: 11075 - DNA, 10 bp, Saccharomyces cerevisiae
tcggggtacc

SEQ ID NO: 11076 - DNA, 10 bp, Saccharomyces cerevisiae
tcggtaataa

SEQ ID NO: 11077 - DNA, 10 bp, Saccharomyces cerevisiae
tcgtacgtca

SEQ ID NO: 11078 - DNA, 10 bp, Saccharomyces cerevisiae
tcgtactggt

SEQ ID NO: 11079 - DNA, 10 bp, Saccharomyces cerevisiae
tcgtactgtt

SEQ ID NO: 11080 - DNA, 10 bp, Saccharomyces cerevisiae
tcgtagaaaa

SEQ ID NO: 11081 - DNA, 10 bp, Saccharomyces cerevisiae
tcgtagtaaa

SEQ ID NO: 11082 - DNA, 10 bp, Saccharomyces cerevisiae
tcgtcaacaa

SEQ ID NO: 11083 - DNA, 10 bp, Saccharomyces cerevisiae
tcgtccgttt

SEQ ID NO: 11084 - DNA, 10 bp, Saccharomyces cerevisiae
tcgtctattt

SEQ ID NO: 11085 - DNA, 10 bp, Saccharomyces cerevisiae
tcgtcttttc

SEQ ID NO: 11086 - DNA, 10 bp, Saccharomyces cerevisiae
tcgtgaatga

SEQ ID NO: 11087 - DNA, 10 bp, Saccharomyces cerevisiae
tcgtgctgtg

SEQ ID NO: 11088 - DNA, 10 bp, Saccharomyces cerevisiae
tcgtggtgga

SEQ ID NO: 11089 - DNA, 10 bp, Saccharomyces cerevisiae
tcgtgtggta

SEQ ID NO: 11090 - DNA, 10 bp, Saccharomyces cerevisiae
tcgtgttaaa

SEQ ID NO: 11091 - DNA, 10 bp, Saccharomyces cerevisiae
tcgttagaag

SEQ ID NO: 11092 - DNA, 10 bp, Saccharomyces cerevisiae
tcgttcaact

SEQ ID NO: 11093 - DNA, 10 bp, Saccharomyces cerevisiae
tcgttcatct

SEQ ID NO: 11094 - DNA, 10 bp, Saccharomyces cerevisiae
tcgttggagc

SEQ ID NO: 11095 - DNA, 10 bp, Saccharomyces cerevisiae
tcgtttactg

SEQ ID NO: 11096 - DNA, 10 bp, Saccharomyces cerevisiae
tcgttttgcc

SEQ ID NO: 11097 - DNA, 10 bp, Saccharomyces cerevisiae
tctaagaaaa

SEQ ID NO: 11098 - DNA, 10 bp, Saccharomyces cerevisiae
tctaagaagt

SEQ ID NO: 11099 - DNA, 10 bp, Saccharomyces cerevisiae
tctaagaccg

SEQ ID NO: 11100 - DNA, 10 bp, Saccharomyces cerevisiae
tctaagatgg

SEQ ID NO: 11101 - DNA, 10 bp, Saccharomyces cerevisiae
tctaagtata

SEQ ID NO: 11102 - DNA, 10 bp, Saccharomyces cerevisiae
tctaagtccc

SEQ ID NO: 11103 - DNA, 10 bp, Saccharomyces cerevisiae
tctaagtctg

SEQ ID NO: 11104 - DNA, 10 bp, Saccharomyces cerevisiae
tctaattacc

SEQ ID NO: 11105 - DNA, 10 bp, Saccharomyces cerevisiae
tctacaactt

SEQ ID NO: 11106 - DNA, 10 bp, Saccharomyces cerevisiae
tctaccgata

SEQ ID NO: 11107 - DNA, 10 bp, Saccharomyces cerevisiae
tctacctcga

SEQ ID NO: 11108 - DNA, 10 bp, Saccharomyces cerevisiae
tctactaaat

SEQ ID NO: 11109 - DNA, 10 bp, Saccharomyces cerevisiae
tctactttac

SEQ ID NO: 11110 - DNA, 10 bp, Saccharomyces cerevisiae
tctagaagtt

SEQ ID NO: 11111 - DNA, 10 bp, Saccharomyces cerevisiae
tctagcgcca

SEQ ID NO: 11112 - DNA, 10 bp, Saccharomyces cerevisiae
tctagcgtac

SEQ ID NO: 11113 - DNA, 10 bp, Saccharomyces cerevisiae
tctagctctc

SEQ ID NO: 11114 - DNA, 10 bp, Saccharomyces cerevisiae
tctaggaagt

SEQ ID NO: 11115 - DNA, 10 bp, Saccharomyces cerevisiae
tctagggatt

SEQ ID NO: 11116 - DNA, 10 bp, Saccharomyces cerevisiae
tctagggtcc

SEQ ID NO: 11117 - DNA, 10 bp, Saccharomyces cerevisiae
tctagtttaa

SEQ ID NO: 11118 - DNA, 10 bp, Saccharomyces cerevisiae
tctatatggt

SEQ ID NO: 11119 - DNA, 10 bp, Saccharomyces cerevisiae
tctatgaaat

SEQ ID NO: 11120 - DNA, 10 bp, Saccharomyces cerevisiae
tctatgtcta

SEQ ID NO: 11121 - DNA, 10 bp, Saccharomyces cerevisiae
tctatgtggt

SEQ ID NO: 11122 - DNA, 10 bp, Saccharomyces cerevisiae
tctatgtgtg

SEQ ID NO: 11123 - DNA, 10 bp, Saccharomyces cerevisiae
tctcaactgg

SEQ ID NO: 11124 - DNA, 10 bp, Saccharomyces cerevisiae
tctcaagctg

SEQ ID NO: 11125 - DNA, 10 bp, Saccharomyces cerevisiae
tctcaaggta

SEQ ID NO: 11126 - DNA, 10 bp, Saccharomyces cerevisiae
tctcagtaat

SEQ ID NO: 11127 - DNA, 10 bp, Saccharomyces cerevisiae
tctccaccta

SEQ ID NO: 11128 - DNA, 10 bp, Saccharomyces cerevisiae
tctccactgg

SEQ ID NO: 11129 - DNA, 10 bp, Saccharomyces cerevisiae
tctccagaga

SEQ ID NO: 11130 - DNA, 10 bp, Saccharomyces cerevisiae
tctccaggaa

SEQ ID NO: 11131 - DNA, 10 bp, Saccharomyces cerevisiae
tctccataac

SEQ ID NO: 11132 - DNA, 10 bp, Saccharomyces cerevisiae
tctcccagag

SEQ ID NO: 11133 - DNA, 10 bp, Saccharomyces cerevisiae
tctcccgaag

SEQ ID NO: 11134 - DNA, 10 bp, Saccharomyces cerevisiae
tctccgcgga

SEQ ID NO: 11135 - DNA, 10 bp, Saccharomyces cerevisiae
tctcctataa

SEQ ID NO: 11136 - DNA, 10 bp, Saccharomyces cerevisiae
tctcctcgtt

SEQ ID NO: 11137 - DNA, 10 bp, Saccharomyces cerevisiae
tctcgtacat

SEQ ID NO: 11138 - DNA, 10 bp, Saccharomyces cerevisiae
tctctaaagg

SEQ ID NO: 11139 - DNA, 10 bp, Saccharomyces cerevisiae
tctctacagg

SEQ ID NO: 11140 - DNA, 10 bp, Saccharomyces cerevisiae
tctctacggg

SEQ ID NO: 11141 - DNA, 10 bp, Saccharomyces cerevisiae
tctctacttt

SEQ ID NO: 11142 - DNA, 10 bp, Saccharomyces cerevisiae
tctctataaa

SEQ ID NO: 11143 - DNA, 10 bp, Saccharomyces cerevisiae
tctctattaa

SEQ ID NO: 11144 - DNA, 10 bp, Saccharomyces cerevisiae
tctctcctca

SEQ ID NO: 11145 - DNA, 10 bp, Saccharomyces cerevisiae
tctctcttgg

SEQ ID NO: 11146 - DNA, 10 bp, Saccharomyces cerevisiae
tctctgacga

SEQ ID NO: 11147 - DNA, 10 bp, Saccharomyces cerevisiae
tctctgccag

SEQ ID NO: 11148 - DNA, 10 bp, Saccharomyces cerevisiae
tctctgctgg

SEQ ID NO: 11149 - DNA, 10 bp, Saccharomyces cerevisiae
tctctttgcc

SEQ ID NO: 11150 - DNA, 10 bp, Saccharomyces cerevisiae
tctgaaaaaa

SEQ ID NO: 11151 - DNA, 10 bp, Saccharomyces cerevisiae
tctgaaattg

SEQ ID NO: 11152 - DNA, 10 bp, Saccharomyces cerevisiae
tctgaagacc

SEQ ID NO: 11153 - DNA, 10 bp, Saccharomyces cerevisiae
tctgacgtgc

SEQ ID NO: 11154 - DNA, 10 bp, Saccharomyces cerevisiae
tctgactggg

SEQ ID NO: 11155 - DNA, 10 bp, Saccharomyces cerevisiae
tctgacttcc

SEQ ID NO: 11156 - DNA, 10 bp, Saccharomyces cerevisiae
tctgagatgg

SEQ ID NO: 11157 - DNA, 10 bp, Saccharomyces cerevisiae
tctgatcttg

SEQ ID NO: 11158 - DNA, 10 bp, Saccharomyces cerevisiae
tctgcaaata

SEQ ID NO: 11159 - DNA, 10 bp, Saccharomyces cerevisiae
tctgcgtgaa

SEQ ID NO: 11160 - DNA, 10 bp, Saccharomyces cerevisiae
tctgctgctg

SEQ ID NO: 11161 - DNA, 10 bp, Saccharomyces cerevisiae
tctggatctc

SEQ ID NO: 11162 - DNA, 10 bp, Saccharomyces cerevisiae
tctggctggc

SEQ ID NO: 11163 - DNA, 10 bp, Saccharomyces cerevisiae
tctggggaaa

SEQ ID NO: 11164 - DNA, 10 bp, Saccharomyces cerevisiae
tctggtgtga

SEQ ID NO: 11165 - DNA, 10 bp, Saccharomyces cerevisiae
tctgtcgaac

SEQ ID NO: 11166 - DNA, 10 bp, Saccharomyces cerevisiae
tctgtcgaga

SEQ ID NO: 11167 - DNA, 10 bp, Saccharomyces cerevisiae
tctgtgacca

SEQ ID NO: 11168 - DNA, 10 bp, Saccharomyces cerevisiae
tctgtgtcca

SEQ ID NO: 11169 - DNA, 10 bp, Saccharomyces cerevisiae
tctgttgaca

SEQ ID NO: 11170 - DNA, 10 bp, Saccharomyces cerevisiae
tctgttgggg

SEQ ID NO: 11171 - DNA, 10 bp, Saccharomyces cerevisiae
tctgttgtca

SEQ ID NO: 11172 - DNA, 10 bp, Saccharomyces cerevisiae
tctgtttggc

SEQ ID NO: 11173 - DNA, 10 bp, Saccharomyces cerevisiae
tcttaagaat

SEQ ID NO: 11174 - DNA, 10 bp, Saccharomyces cerevisiae
tcttacatat

SEQ ID NO: 11175 - DNA, 10 bp, Saccharomyces cerevisiae
tcttaccaca

SEQ ID NO: 11176 - DNA, 10 bp, Saccharomyces cerevisiae
tcttacccat

SEQ ID NO: 11177 - DNA, 10 bp, Saccharomyces cerevisiae
tcttatcatt

SEQ ID NO: 11178 - DNA, 10 bp, Saccharomyces cerevisiae
tcttattatc

SEQ ID NO: 11179 - DNA, 10 bp, Saccharomyces cerevisiae
tcttcaaaga

SEQ ID NO: 11180 - DNA, 10 bp, Saccharomyces cerevisiae
tcttcaactt

SEQ ID NO: 11181 - DNA, 10 bp, Saccharomyces cerevisiae
tcttcattac

SEQ ID NO: 11182 - DNA, 10 bp, Saccharomyces cerevisiae
tcttccaaaa

SEQ ID NO: 11183 - DNA, 10 bp, Saccharomyces cerevisiae
tcttcccact

SEQ ID NO: 11184 - DNA, 10 bp, Saccharomyces cerevisiae
tcttcgacaa

SEQ ID NO: 11185 - DNA, 10 bp, Saccharomyces cerevisiae
tcttctcgtc

SEQ ID NO: 11186 - DNA, 10 bp, Saccharomyces cerevisiae
tcttcttcag

SEQ ID NO: 11187 - DNA, 10 bp, Saccharomyces cerevisiae
tcttcttctt

SEQ ID NO: 11188 - DNA, 10 bp, Saccharomyces cerevisiae
tcttgaaaaa

SEQ ID NO: 11189 - DNA, 10 bp, Saccharomyces cerevisiae
tcttgaactg

SEQ ID NO: 11190 - DNA, 10 bp, Saccharomyces cerevisiae
tcttgaccgt

SEQ ID NO: 11191 - DNA, 10 bp, Saccharomyces cerevisiae
tcttgagaaa

SEQ ID NO: 11192 - DNA, 10 bp, Saccharomyces cerevisiae
tcttgagaac

SEQ ID NO: 11193 - DNA, 10 bp, Saccharomyces cerevisiae
tcttgaggat

SEQ ID NO: 11194 - DNA, 10 bp, Saccharomyces cerevisiae
tcttgggaat

SEQ ID NO: 11195 - DNA, 10 bp, Saccharomyces cerevisiae
tcttgtagaa

SEQ ID NO: 11196 - DNA, 10 bp, Saccharomyces cerevisiae
tcttgtagga

SEQ ID NO: 11197 - DNA, 10 bp, Saccharomyces cerevisiae
tcttgtgaaa

SEQ ID NO: 11198 - DNA, 10 bp, Saccharomyces cerevisiae
tcttgtggtt

SEQ ID NO: 11199 - DNA, 10 bp, Saccharomyces cerevisiae
tctttaatgg

SEQ ID NO: 11200 - DNA, 10 bp, Saccharomyces cerevisiae
tctttaccag

SEQ ID NO: 11201 - DNA, 10 bp, Saccharomyces cerevisiae
tctttatgta

SEQ ID NO: 11202 - DNA, 10 bp, Saccharomyces cerevisiae
tctttattta

SEQ ID NO: 11203 - DNA, 10 bp, Saccharomyces cerevisiae
tctttcctga

SEQ ID NO: 11204 - DNA, 10 bp, Saccharomyces cerevisiae
tctttgtcta

SEQ ID NO: 11205 - DNA, 10 bp, Saccharomyces cerevisiae
tcttttgtgt

SEQ ID NO: 11206 - DNA, 10 bp, Saccharomyces cerevisiae
tctttttata

SEQ ID NO: 11207 - DNA, 10 bp, Saccharomyces cerevisiae
tctttttcac

SEQ ID NO: 11208 - DNA, 10 bp, Saccharomyces cerevisiae
tctttttgta

SEQ ID NO: 11209 - DNA, 10 bp, Saccharomyces cerevisiae
tgaaaacttt

SEQ ID NO: 11210 - DNA, 10 bp, Saccharomyces cerevisiae
tgaaaagaag

SEQ ID NO: 11211 - DNA, 10 bp, Saccharomyces cerevisiae
tgaaaatgta

SEQ ID NO: 11212 - DNA, 10 bp, Saccharomyces cerevisiae
tgaaacggtg

SEQ ID NO: 11213 - DNA, 10 bp, Saccharomyces cerevisiae
tgaaattatg

SEQ ID NO: 11214 - DNA, 10 bp, Saccharomyces cerevisiae
tgaacaacat

SEQ ID NO: 11215 - DNA, 10 bp, Saccharomyces cerevisiae
tgaacaatgt

SEQ ID NO: 11216 - DNA, 10 bp, Saccharomyces cerevisiae
tgaacagcgg

SEQ ID NO: 11217 - DNA, 10 bp, Saccharomyces cerevisiae
tgaactctaa

SEQ ID NO: 11218 - DNA, 10 bp, Saccharomyces cerevisiae
tgaacttttc

SEQ ID NO: 11219 - DNA, 10 bp, Saccharomyces cerevisiae
tgaaggaaca

SEQ ID NO: 11220 - DNA, 10 bp, Saccharomyces cerevisiae
tgaaggtgat

SEQ ID NO: 11221 - DNA, 10 bp, Saccharomyces cerevisiae
tgaatcaaaa

SEQ ID NO: 11222 - DNA, 10 bp, Saccharomyces cerevisiae
tgaatgcctg

SEQ ID NO: 11223 - DNA, 10 bp, Saccharomyces cerevisiae
tgaattagtg

SEQ ID NO: 11224 - DNA, 10 bp, Saccharomyces cerevisiae
tgaattgact

SEQ ID NO: 11225 - DNA, 10 bp, Saccharomyces cerevisiae
tgaatttcat

SEQ ID NO: 11226 - DNA, 10 bp, Saccharomyces cerevisiae
tgaattttcc

SEQ ID NO: 11227 - DNA, 10 bp, Saccharomyces cerevisiae
tgacaaaact

SEQ ID NO: 11228 - DNA, 10 bp, Saccharomyces cerevisiae
tgacaaactg

SEQ ID NO: 11229 - DNA, 10 bp, Saccharomyces cerevisiae
tgacaactat

SEQ ID NO: 11230 - DNA, 10 bp, Saccharomyces cerevisiae
tgacaactgt

SEQ ID NO: 11231 - DNA, 10 bp, Saccharomyces cerevisiae
tgacaagaat

SEQ ID NO: 11232 - DNA, 10 bp, Saccharomyces cerevisiae
tgacaagcct

SEQ ID NO: 11233 - DNA, 10 bp, Saccharomyces cerevisiae
tgacacattc

SEQ ID NO: 11234 - DNA, 10 bp, Saccharomyces cerevisiae
tgacaggaaa

SEQ ID NO: 11235 - DNA, 10 bp, Saccharomyces cerevisiae
tgacataagt

SEQ ID NO: 11236 - DNA, 10 bp, Saccharomyces cerevisiae
tgaccaaaca

SEQ ID NO: 11237 - DNA, 10 bp, Saccharomyces cerevisiae
tgacggctga

SEQ ID NO: 11238 - DNA, 10 bp, Saccharomyces cerevisiae
tgacggtttg

SEQ ID NO: 11239 - DNA, 10 bp, Saccharomyces cerevisiae
tgactcgttg

SEQ ID NO: 11240 - DNA, 10 bp, Saccharomyces cerevisiae
tgactcttgg

SEQ ID NO: 11241 - DNA, 10 bp, Saccharomyces cerevisiae
tgactggtat

SEQ ID NO: 11242 - DNA, 10 bp, Saccharomyces cerevisiae
tgagatccga

SEQ ID NO: 11243 - DNA, 10 bp, Saccharomyces cerevisiae
tgagatcggg

SEQ ID NO: 11244 - DNA, 10 bp, Saccharomyces cerevisiae
tgagcacaat

SEQ ID NO: 11245 - DNA, 10 bp, Saccharomyces cerevisiae
tgagcatatc

SEQ ID NO: 11246 - DNA, 10 bp, Saccharomyces cerevisiae
tgagccttcg

SEQ ID NO: 11247 - DNA, 10 bp, Saccharomyces cerevisiae
tgagcgttga

SEQ ID NO: 11248 - DNA, 10 bp, Saccharomyces cerevisiae
tgagcttaga

SEQ ID NO: 11249 - DNA, 10 bp, Saccharomyces cerevisiae
tgagggtgta

SEQ ID NO: 11250 - DNA, 10 bp, Saccharomyces cerevisiae
tgaggtaagt

SEQ ID NO: 11251 - DNA, 10 bp, Saccharomyces cerevisiae
tgaggtgata

SEQ ID NO: 11252 - DNA, 10 bp, Saccharomyces cerevisiae
tgagtaggag

SEQ ID NO: 11253 - DNA, 10 bp, Saccharomyces cerevisiae
tgagtatata

SEQ ID NO: 11254 - DNA, 10 bp, Saccharomyces cerevisiae
tgagtggtca

SEQ ID NO: 11255 - DNA, 10 bp, Saccharomyces cerevisiae
tgagtgtcta

SEQ ID NO: 11256 - DNA, 10 bp, Saccharomyces cerevisiae
tgagttagag

SEQ ID NO: 11257 - DNA, 10 bp, Saccharomyces cerevisiae
tgataatgat

SEQ ID NO: 11258 - DNA, 10 bp, Saccharomyces cerevisiae
tgataatgtc

SEQ ID NO: 11259 - DNA, 10 bp, Saccharomyces cerevisiae
tgataccaag

SEQ ID NO: 11260 - DNA, 10 bp, Saccharomyces cerevisiae
tgatagcagt

SEQ ID NO: 11261 - DNA, 10 bp, Saccharomyces cerevisiae
tgatatcaga

SEQ ID NO: 11262 - DNA, 10 bp, Saccharomyces cerevisiae
tgatatcagt

SEQ ID NO: 11263 - DNA, 10 bp, Saccharomyces cerevisiae
tgatatgtaa

SEQ ID NO: 11264 - DNA, 10 bp, Saccharomyces cerevisiae
tgatcaaaaa

SEQ ID NO: 11265 - DNA, 10 bp, Saccharomyces cerevisiae
tgatcaagcg

SEQ ID NO: 11266 - DNA, 10 bp, Saccharomyces cerevisiae
tgatcggttg

SEQ ID NO: 11267 - DNA, 10 bp, Saccharomyces cerevisiae
tgatcgtttg

SEQ ID NO: 11268 - DNA, 10 bp, Saccharomyces cerevisiae
tgatctgcac

SEQ ID NO: 11269 - DNA, 10 bp, Saccharomyces cerevisiae
tgatcttaag

SEQ ID NO: 11270 - DNA, 10 bp, Saccharomyces cerevisiae
tgatcttcct

SEQ ID NO: 11271 - DNA, 10 bp, Saccharomyces cerevisiae
tgatgactct

SEQ ID NO: 11272 - DNA, 10 bp, Saccharomyces cerevisiae
tgatggtcgg

SEQ ID NO: 11273 - DNA, 10 bp, Saccharomyces cerevisiae
tgattataca

SEQ ID NO: 11274 - DNA, 10 bp, Saccharomyces cerevisiae
tgattatacc

SEQ ID NO: 11275 - DNA, 10 bp, Saccharomyces cerevisiae
tgattatccc

SEQ ID NO: 11276 - DNA, 10 bp, Saccharomyces cerevisiae
tgattattag

SEQ ID NO: 11277 - DNA, 10 bp, Saccharomyces cerevisiae
tgattcccca

SEQ ID NO: 11278 - DNA, 10 bp, Saccharomyces cerevisiae
tgattctctc

SEQ ID NO: 11279 - DNA, 10 bp, Saccharomyces cerevisiae
tgattctgtt

SEQ ID NO: 11280 - DNA, 10 bp, Saccharomyces cerevisiae
tgattgccgt

SEQ ID NO: 11281 - DNA, 10 bp, Saccharomyces cerevisiae
tgatttgttg

SEQ ID NO: 11282 - DNA, 10 bp, Saccharomyces cerevisiae
tgcaaataaa

SEQ ID NO: 11283 - DNA, 10 bp, Saccharomyces cerevisiae
tgcaagaaca

SEQ ID NO: 11284 - DNA, 10 bp, Saccharomyces cerevisiae
tgcaatttgc

SEQ ID NO: 11285 - DNA, 10 bp, Saccharomyces cerevisiae
tgcacagaac

SEQ ID NO: 11286 - DNA, 10 bp, Saccharomyces cerevisiae
tgcacctctt

SEQ ID NO: 11287 - DNA, 10 bp, Saccharomyces cerevisiae
tgcactagta

SEQ ID NO: 11288 - DNA, 10 bp, Saccharomyces cerevisiae
tgcagaagag

SEQ ID NO: 11289 - DNA, 10 bp, Saccharomyces cerevisiae
tgcagagaac

SEQ ID NO: 11290 - DNA, 10 bp, Saccharomyces cerevisiae
tgcagcggct

SEQ ID NO: 11291 - DNA, 10 bp, Saccharomyces cerevisiae
tgcagtcaaa

SEQ ID NO: 11292 - DNA, 10 bp, Saccharomyces cerevisiae
tgcagtttag

SEQ ID NO: 11293 - DNA, 10 bp, Saccharomyces cerevisiae
tgcatatccg

SEQ ID NO: 11294 - DNA, 10 bp, Saccharomyces cerevisiae
tgcatcacca

SEQ ID NO: 11295 - DNA, 10 bp, Saccharomyces cerevisiae
tgcatcttta

SEQ ID NO: 11296 - DNA, 10 bp, Saccharomyces cerevisiae
tgcattattg

SEQ ID NO: 11297 - DNA, 10 bp, Saccharomyces cerevisiae
tgcattgata

SEQ ID NO: 11298 - DNA, 10 bp, Saccharomyces cerevisiae
tgccaacaaa

SEQ ID NO: 11299 - DNA, 10 bp, Saccharomyces cerevisiae
tgccaaggat

SEQ ID NO: 11300 - DNA, 10 bp, Saccharomyces cerevisiae
tgccacgaac

SEQ ID NO: 11301 - DNA, 10 bp, Saccharomyces cerevisiae
tgccactatt

SEQ ID NO: 11302 - DNA, 10 bp, Saccharomyces cerevisiae
tgccagcaga

SEQ ID NO: 11303 - DNA, 10 bp, Saccharomyces cerevisiae
tgccatctat

SEQ ID NO: 11304 - DNA, 10 bp, Saccharomyces cerevisiae
tgccatttta

SEQ ID NO: 11305 - DNA, 10 bp, Saccharomyces cerevisiae
tgcccgtaca

SEQ ID NO: 11306 - DNA, 10 bp, Saccharomyces cerevisiae
tgccctgtgg

SEQ ID NO: 11307 - DNA, 10 bp, Saccharomyces cerevisiae
tgcccttgat

SEQ ID NO: 11308 - DNA, 10 bp, Saccharomyces cerevisiae
tgccgactac

SEQ ID NO: 11309 - DNA, 10 bp, Saccharomyces cerevisiae
tgccgccttc

SEQ ID NO: 11310 - DNA, 10 bp, Saccharomyces cerevisiae
tgccgtccat

SEQ ID NO: 11311 - DNA, 10 bp, Saccharomyces cerevisiae
tgccgtggtg

SEQ ID NO: 11312 - DNA, 10 bp, Saccharomyces cerevisiae
tgcctatgct

SEQ ID NO: 11313 - DNA, 10 bp, Saccharomyces cerevisiae
tgcctattaa

SEQ ID NO: 11314 - DNA, 10 bp, Saccharomyces cerevisiae
tgcctcagcg

SEQ ID NO: 11315 - DNA, 10 bp, Saccharomyces cerevisiae
tgcctctggg

SEQ ID NO: 11316 - DNA, 10 bp, Saccharomyces cerevisiae
tgcctggact

SEQ ID NO: 11317 - DNA, 10 bp, Saccharomyces cerevisiae
tgcctggtac

SEQ ID NO: 11318 - DNA, 10 bp, Saccharomyces cerevisiae
tgccttatgt

SEQ ID NO: 11319 - DNA, 10 bp, Saccharomyces cerevisiae
tgccttcgtc

SEQ ID NO: 11320 - DNA, 10 bp, Saccharomyces cerevisiae
tgccttgtgg

SEQ ID NO: 11321 - DNA, 10 bp, Saccharomyces cerevisiae
tgcctttgtg

SEQ ID NO: 11322 - DNA, 10 bp, Saccharomyces cerevisiae
tgccttttca

SEQ ID NO: 11323 - DNA, 10 bp, Saccharomyces cerevisiae
tgcgactcaa

SEQ ID NO: 11324 - DNA, 10 bp, Saccharomyces cerevisiae
tgcgagatac

SEQ ID NO: 11325 - DNA, 10 bp, Saccharomyces cerevisiae
tgcgcaaact

SEQ ID NO: 11326 - DNA, 10 bp, Saccharomyces cerevisiae
tgcgcagcag

SEQ ID NO: 11327 - DNA, 10 bp, Saccharomyces cerevisiae
tgcgctttct

SEQ ID NO: 11328 - DNA, 10 bp, Saccharomyces cerevisiae
tgcggacctt

SEQ ID NO: 11329 - DNA, 10 bp, Saccharomyces cerevisiae
tgcgggtcac

SEQ ID NO: 11330 - DNA, 10 bp, Saccharomyces cerevisiae
tgcgtccagc

SEQ ID NO: 11331 - DNA, 10 bp, Saccharomyces cerevisiae
tgcgtgcaat

SEQ ID NO: 11332 - DNA, 10 bp, Saccharomyces cerevisiae
tgcgtgcgtg

SEQ ID NO: 11333 - DNA, 10 bp, Saccharomyces cerevisiae
tgcgtggacc

SEQ ID NO: 11334 - DNA, 10 bp, Saccharomyces cerevisiae
tgcgtggact

SEQ ID NO: 11335 - DNA, 10 bp, Saccharomyces cerevisiae
tgcgtggtgg

SEQ ID NO: 11336 - DNA, 10 bp, Saccharomyces cerevisiae
tgcgttaaaa

SEQ ID NO: 11337 - DNA, 10 bp, Saccharomyces cerevisiae
tgcgttaaat

SEQ ID NO: 11338 - DNA, 10 bp, Saccharomyces cerevisiae
tgcgttatgg

SEQ ID NO: 11339 - DNA, 10 bp, Saccharomyces cerevisiae
tgcgttgtcg

SEQ ID NO: 11340 - DNA, 10 bp, Saccharomyces cerevisiae
tgctaaaggt

SEQ ID NO: 11341 - DNA, 10 bp, Saccharomyces cerevisiae
tgctattgat

SEQ ID NO: 11342 - DNA, 10 bp, Saccharomyces cerevisiae
tgctatttca

SEQ ID NO: 11343 - DNA, 10 bp, Saccharomyces cerevisiae
tgctcaaaaa

SEQ ID NO: 11344 - DNA, 10 bp, Saccharomyces cerevisiae
tgctcagcgc

SEQ ID NO: 11345 - DNA, 10 bp, Saccharomyces cerevisiae
tgctcttcgc

SEQ ID NO: 11346 - DNA, 10 bp, Saccharomyces cerevisiae
tgctgacaac

SEQ ID NO: 11347 - DNA, 10 bp, Saccharomyces cerevisiae
tgctgagaac

SEQ ID NO: 11348 - DNA, 10 bp, Saccharomyces cerevisiae
tgctgcccgc

SEQ ID NO: 11349 - DNA, 10 bp, Saccharomyces cerevisiae
tgctgtcaca

SEQ ID NO: 11350 - DNA, 10 bp, Saccharomyces cerevisiae
tgctgttgtt

SEQ ID NO: 11351 - DNA, 10 bp, Saccharomyces cerevisiae
tgcttaacta

SEQ ID NO: 11352 - DNA, 10 bp, Saccharomyces cerevisiae
tgcttcaact

SEQ ID NO: 11353 - DNA, 10 bp, Saccharomyces cerevisiae
tgcttcccct

SEQ ID NO: 11354 - DNA, 10 bp, Saccharomyces cerevisiae
tgcttgtatt

SEQ ID NO: 11355 - DNA, 10 bp, Saccharomyces cerevisiae
tggaactacc

SEQ ID NO: 11356 - DNA, 10 bp, Saccharomyces cerevisiae
tggaacttct

SEQ ID NO: 11357 - DNA, 10 bp, Saccharomyces cerevisiae
tggaagagga

SEQ ID NO: 11358 - DNA, 10 bp, Saccharomyces cerevisiae
tggaagctag

SEQ ID NO: 11359 - DNA, 10 bp, Saccharomyces cerevisiae
tggaagcttc

SEQ ID NO: 11360 - DNA, 10 bp, Saccharomyces cerevisiae
tggaatggac

SEQ ID NO: 11361 - DNA, 10 bp, Saccharomyces cerevisiae
tggaatgtgg

SEQ ID NO: 11362 - DNA, 10 bp, Saccharomyces cerevisiae
tggacaccgt

SEQ ID NO: 11363 - DNA, 10 bp, Saccharomyces cerevisiae
tggacacctt

SEQ ID NO: 11364 - DNA, 10 bp, Saccharomyces cerevisiae
tggactaccg

SEQ ID NO: 11365 - DNA, 10 bp, Saccharomyces cerevisiae
tggagaatgt

SEQ ID NO: 11366 - DNA, 10 bp, Saccharomyces cerevisiae
tggagattaa

SEQ ID NO: 11367 - DNA, 10 bp, Saccharomyces cerevisiae
tggaggtttg

SEQ ID NO: 11368 - DNA, 10 bp, Saccharomyces cerevisiae
tggagtactc

SEQ ID NO: 11369 - DNA, 10 bp, Saccharomyces cerevisiae
tggagtagaa

SEQ ID NO: 11370 - DNA, 10 bp, Saccharomyces cerevisiae
tggagtatat

SEQ ID NO: 11371 - DNA, 10 bp, Saccharomyces cerevisiae
tggagtatgg

SEQ ID NO: 11372 - DNA, 10 bp, Saccharomyces cerevisiae
tggagtccct

SEQ ID NO: 11373 - DNA, 10 bp, Saccharomyces cerevisiae
tggagtcgtg

SEQ ID NO: 11374 - DNA, 10 bp, Saccharomyces cerevisiae
tggagtgaga

SEQ ID NO: 11375 - DNA, 10 bp, Saccharomyces cerevisiae
tggataaaga

SEQ ID NO: 11376 - DNA, 10 bp, Saccharomyces cerevisiae
tggatcatat

SEQ ID NO: 11377 - DNA, 10 bp, Saccharomyces cerevisiae
tggatgaacc

SEQ ID NO: 11378 - DNA, 10 bp, Saccharomyces cerevisiae
tggatgacga

SEQ ID NO: 11379 - DNA, 10 bp, Saccharomyces cerevisiae
tggattgttg

SEQ ID NO: 11380 - DNA, 10 bp, Saccharomyces cerevisiae
tggcaccctg

SEQ ID NO: 11381 - DNA, 10 bp, Saccharomyces cerevisiae
tggcacctag

SEQ ID NO: 11382 - DNA, 10 bp, Saccharomyces cerevisiae
tggcacttgg

SEQ ID NO: 11383 - DNA, 10 bp, Saccharomyces cerevisiae
tggcagtcta

SEQ ID NO: 11384 - DNA, 10 bp, Saccharomyces cerevisiae
tggcatcctg

SEQ ID NO: 11385 - DNA, 10 bp, Saccharomyces cerevisiae
tggcattctc

SEQ ID NO: 11386 - DNA, 10 bp, Saccharomyces cerevisiae
tggccaccag

SEQ ID NO: 11387 - DNA, 10 bp, Saccharomyces cerevisiae
tggccaccat

SEQ ID NO: 11388 - DNA, 10 bp, Saccharomyces cerevisiae
tggcgaaaaa

SEQ ID NO: 11389 - DNA, 10 bp, Saccharomyces cerevisiae
tggcgaagtc

SEQ ID NO: 11390 - DNA, 10 bp, Saccharomyces cerevisiae
tggcgacaag

SEQ ID NO: 11391 - DNA, 10 bp, Saccharomyces cerevisiae
tggcgatatt

SEQ ID NO: 11392 - DNA, 10 bp, Saccharomyces cerevisiae
tggcgatgga

SEQ ID NO: 11393 - DNA, 10 bp, Saccharomyces cerevisiae
tggcgccgca

SEQ ID NO: 11394 - DNA, 10 bp, Saccharomyces cerevisiae
tggcgtggtg

SEQ ID NO: 11395 - DNA, 10 bp, Saccharomyces cerevisiae
tggctaataa

SEQ ID NO: 11396 - DNA, 10 bp, Saccharomyces cerevisiae
tggctctttg

SEQ ID NO: 11397 - DNA, 10 bp, Saccharomyces cerevisiae
tggctggttg

SEQ ID NO: 11398 - DNA, 10 bp, Saccharomyces cerevisiae
tggcttaaaa

SEQ ID NO: 11399 - DNA, 10 bp, Saccharomyces cerevisiae
tggctttgga

SEQ ID NO: 11400 - DNA, 10 bp, Saccharomyces cerevisiae
tgggaaattt

SEQ ID NO: 11401 - DNA, 10 bp, Saccharomyces cerevisiae
tgggaacgac

SEQ ID NO: 11402 - DNA, 10 bp, Saccharomyces cerevisiae
tgggacactg

SEQ ID NO: 11403 - DNA, 10 bp, Saccharomyces cerevisiae
tgggaggtga

SEQ ID NO: 11404 - DNA, 10 bp, Saccharomyces cerevisiae
tgggagtacc

SEQ ID NO: 11405 - DNA, 10 bp, Saccharomyces cerevisiae
tgggatggac

SEQ ID NO: 11406 - DNA, 10 bp, Saccharomyces cerevisiae
tgggctatct

SEQ ID NO: 11407 - DNA, 10 bp, Saccharomyces cerevisiae
tgggcttgga

SEQ ID NO: 11408 - DNA, 10 bp, Saccharomyces cerevisiae
tggggaactg

SEQ ID NO: 11409 - DNA, 10 bp, Saccharomyces cerevisiae
tggggactcg

SEQ ID NO: 11410 - DNA, 10 bp, Saccharomyces cerevisiae
tggggcttgg

SEQ ID NO: 11411 - DNA, 10 bp, Saccharomyces cerevisiae
tggggtgagg

SEQ ID NO: 11412 - DNA, 10 bp, Saccharomyces cerevisiae
tggggtgcga

SEQ ID NO: 11413 - DNA, 10 bp, Saccharomyces cerevisiae
tggggttgtg

SEQ ID NO: 11414 - DNA, 10 bp, Saccharomyces cerevisiae
tgggtaagca

SEQ ID NO: 11415 - DNA, 10 bp, Saccharomyces cerevisiae
tgggtagtga

SEQ ID NO: 11416 - DNA, 10 bp, Saccharomyces cerevisiae
tgggtgctct

SEQ ID NO: 11417 - DNA, 10 bp, Saccharomyces cerevisiae
tgggtgtcta

SEQ ID NO: 11418 - DNA, 10 bp, Saccharomyces cerevisiae
tgggtgtgga

SEQ ID NO: 11419 - DNA, 10 bp, Saccharomyces cerevisiae
tgggttggga

SEQ ID NO: 11420 - DNA, 10 bp, Saccharomyces cerevisiae
tgggttggtg

SEQ ID NO: 11421 - DNA, 10 bp, Saccharomyces cerevisiae
tgggtttggg

SEQ ID NO: 11422 - DNA, 10 bp, Saccharomyces cerevisiae
tgggtttttg

SEQ ID NO: 11423 - DNA, 10 bp, Saccharomyces cerevisiae
tggtaaataa

SEQ ID NO: 11424 - DNA, 10 bp, Saccharomyces cerevisiae
tggtaaggtg

SEQ ID NO: 11425 - DNA, 10 bp, Saccharomyces cerevisiae
tggtactaga

SEQ ID NO: 11426 - DNA, 10 bp, Saccharomyces cerevisiae
tggtactatt

SEQ ID NO: 11427 - DNA, 10 bp, Saccharomyces cerevisiae
tggtagagaa

SEQ ID NO: 11428 - DNA, 10 bp, Saccharomyces cerevisiae
tggtagcggt

SEQ ID NO: 11429 - DNA, 10 bp, Saccharomyces cerevisiae
tggtattagg

SEQ ID NO: 11430 - DNA, 10 bp, Saccharomyces cerevisiae
tggtcataaa

SEQ ID NO: 11431 - DNA, 10 bp, Saccharomyces cerevisiae
tggtcattaa

SEQ ID NO: 11432 - DNA, 10 bp, Saccharomyces cerevisiae
tggtcccaca

SEQ ID NO: 11433 - DNA, 10 bp, Saccharomyces cerevisiae
tggtcgaaga

SEQ ID NO: 11434 - DNA, 10 bp, Saccharomyces cerevisiae
tggtcgagcc

SEQ ID NO: 11435 - DNA, 10 bp, Saccharomyces cerevisiae
tggtcgctgt

SEQ ID NO: 11436 - DNA, 10 bp, Saccharomyces cerevisiae
tggtcggaga

SEQ ID NO: 11437 - DNA, 10 bp, Saccharomyces cerevisiae
tggtcttcta

SEQ ID NO: 11438 - DNA, 10 bp, Saccharomyces cerevisiae
tggtgaaata

SEQ ID NO: 11439 - DNA, 10 bp, Saccharomyces cerevisiae
tggtgaaatg

SEQ ID NO: 11440 - DNA, 10 bp, Saccharomyces cerevisiae
tggtgaattt

SEQ ID NO: 11441 - DNA, 10 bp, Saccharomyces cerevisiae
tggtgactgt

SEQ ID NO: 11442 - DNA, 10 bp, Saccharomyces cerevisiae
tggtgattta

SEQ ID NO: 11443 - DNA, 10 bp, Saccharomyces cerevisiae
tggtgcggct

SEQ ID NO: 11444 - DNA, 10 bp, Saccharomyces cerevisiae
tggtggaaaa

SEQ ID NO: 11445 - DNA, 10 bp, Saccharomyces cerevisiae
tggtggaaat

SEQ ID NO: 11446 - DNA, 10 bp, Saccharomyces cerevisiae
tggtggagtc

SEQ ID NO: 11447 - DNA, 10 bp, Saccharomyces cerevisiae
tggtgttagt

SEQ ID NO: 11448 - DNA, 10 bp, Saccharomyces cerevisiae
tggttaaaaa

SEQ ID NO: 11449 - DNA, 10 bp, Saccharomyces cerevisiae
tggttaaaat

SEQ ID NO: 11450 - DNA, 10 bp, Saccharomyces cerevisiae
tggttgaagg

SEQ ID NO: 11451 - DNA, 10 bp, Saccharomyces cerevisiae
tggttgccaa

SEQ ID NO: 11452 - DNA, 10 bp, Saccharomyces cerevisiae
tggtttaaaa

SEQ ID NO: 11453 - DNA, 10 bp, Saccharomyces cerevisiae
tgtaaaattt

SEQ ID NO: 11454 - DNA, 10 bp, Saccharomyces cerevisiae
tgtaaagtta

SEQ ID NO: 11455 - DNA, 10 bp, Saccharomyces cerevisiae
tgtaaccttt

SEQ ID NO: 11456 - DNA, 10 bp, Saccharomyces cerevisiae
tgtaacgttt

SEQ ID NO: 11457 - DNA, 10 bp, Saccharomyces cerevisiae
tgtaagaacc

SEQ ID NO: 11458 - DNA, 10 bp, Saccharomyces cerevisiae
tgtaagaact

SEQ ID NO: 11459 - DNA, 10 bp, Saccharomyces cerevisiae
tgtaagttgg

SEQ ID NO: 11460 - DNA, 10 bp, Saccharomyces cerevisiae
tgtaatgata

SEQ ID NO: 11461 - DNA, 10 bp, Saccharomyces cerevisiae
tgtaattaac

SEQ ID NO: 11462 - DNA, 10 bp, Saccharomyces cerevisiae
tgtaccagtt

SEQ ID NO: 11463 - DNA, 10 bp, Saccharomyces cerevisiae
tgtacgcaga

SEQ ID NO: 11464 - DNA, 10 bp, Saccharomyces cerevisiae
tgtacgcggt

SEQ ID NO: 11465 - DNA, 10 bp, Saccharomyces cerevisiae
tgtactacga

SEQ ID NO: 11466 - DNA, 10 bp, Saccharomyces cerevisiae
tgtactgatg

SEQ ID NO: 11467 - DNA, 10 bp, Saccharomyces cerevisiae
tgtagctact

SEQ ID NO: 11468 - DNA, 10 bp, Saccharomyces cerevisiae
tgtataattt

SEQ ID NO: 11469 - DNA, 10 bp, Saccharomyces cerevisiae
tgtatactta

SEQ ID NO: 11470 - DNA, 10 bp, Saccharomyces cerevisiae
tgtatatcta

SEQ ID NO: 11471 - DNA, 10 bp, Saccharomyces cerevisiae
tgtatatttt

SEQ ID NO: 11472 - DNA, 10 bp, Saccharomyces cerevisiae
tgtatctggg

SEQ ID NO: 11473 - DNA, 10 bp, Saccharomyces cerevisiae
tgtatgaaaa

SEQ ID NO: 11474 - DNA, 10 bp, Saccharomyces cerevisiae
tgtatgtaat

SEQ ID NO: 11475 - DNA, 10 bp, Saccharomyces cerevisiae
tgtatgtaca

SEQ ID NO: 11476 - DNA, 10 bp, Saccharomyces cerevisiae
tgtattatat

SEQ ID NO: 11477 - DNA, 10 bp, Saccharomyces cerevisiae
tgtattcata

SEQ ID NO: 11478 - DNA, 10 bp, Saccharomyces cerevisiae
tgtattttaa

SEQ ID NO: 11479 - DNA, 10 bp, Saccharomyces cerevisiae
tgtcaaatca

SEQ ID NO: 11480 - DNA, 10 bp, Saccharomyces cerevisiae
tgtcaacgca

SEQ ID NO: 11481 - DNA, 10 bp, Saccharomyces cerevisiae
tgtcaagtgg

SEQ ID NO: 11482 - DNA, 10 bp, Saccharomyces cerevisiae
tgtcaatcca

SEQ ID NO: 11483 - DNA, 10 bp, Saccharomyces cerevisiae
tgtcagaaaa

SEQ ID NO: 11484 - DNA, 10 bp, Saccharomyces cerevisiae
tgtcattttg

SEQ ID NO: 11485 - DNA, 10 bp, Saccharomyces cerevisiae
tgtccaaata

SEQ ID NO: 11486 - DNA, 10 bp, Saccharomyces cerevisiae
tgtccactgc

SEQ ID NO: 11487 - DNA, 10 bp, Saccharomyces cerevisiae
tgtcccgatc

SEQ ID NO: 11488 - DNA, 10 bp, Saccharomyces cerevisiae
tgtcctgtat

SEQ ID NO: 11489 - DNA, 10 bp, Saccharomyces cerevisiae
tgtcgacgac

SEQ ID NO: 11490 - DNA, 10 bp, Saccharomyces cerevisiae
tgtcgctgtg

SEQ ID NO: 11491 - DNA, 10 bp, Saccharomyces cerevisiae
tgtcggaaat

SEQ ID NO: 11492 - DNA, 10 bp, Saccharomyces cerevisiae
tgtcgggtgg

SEQ ID NO: 11493 - DNA, 10 bp, Saccharomyces cerevisiae
tgtcgtgctg

SEQ ID NO: 11494 - DNA, 10 bp, Saccharomyces cerevisiae
tgtcgtggcg

SEQ ID NO: 11495 - DNA, 10 bp, Saccharomyces cerevisiae
tgtcgtggta

SEQ ID NO: 11496 - DNA, 10 bp, Saccharomyces cerevisiae
tgtcgtggtc

SEQ ID NO: 11497 - DNA, 10 bp, Saccharomyces cerevisiae
tgtcgttgtg

SEQ ID NO: 11498 - DNA, 10 bp, Saccharomyces cerevisiae
tgtctatcat

SEQ ID NO: 11499 - DNA, 10 bp, Saccharomyces cerevisiae
tgtctcagca

SEQ ID NO: 11500 - DNA, 10 bp, Saccharomyces cerevisiae
tgtctcgcga

SEQ ID NO: 11501 - DNA, 10 bp, Saccharomyces cerevisiae
tgtctcttgt

SEQ ID NO: 11502 - DNA, 10 bp, Saccharomyces cerevisiae
tgtctggtgg

SEQ ID NO: 11503 - DNA, 10 bp, Saccharomyces cerevisiae
tgtctgtatt

SEQ ID NO: 11504 - DNA, 10 bp, Saccharomyces cerevisiae
tgtctttggt

SEQ ID NO: 11505 - DNA, 10 bp, Saccharomyces cerevisiae
tgtgacgcag

SEQ ID NO: 11506 - DNA, 10 bp, Saccharomyces cerevisiae
tgtgactagt

SEQ ID NO: 11507 - DNA, 10 bp, Saccharomyces cerevisiae
tgtgagacgg

SEQ ID NO: 11508 - DNA, 10 bp, Saccharomyces cerevisiae
tgtgagtgaa

SEQ ID NO: 11509 - DNA, 10 bp, Saccharomyces cerevisiae
tgtgatttaa

SEQ ID NO: 11510 - DNA, 10 bp, Saccharomyces cerevisiae
tgtgcagagg

SEQ ID NO: 11511 - DNA, 10 bp, Saccharomyces cerevisiae
tgtgccatcg

SEQ ID NO: 11512 - DNA, 10 bp, Saccharomyces cerevisiae
tgtgcctaat

SEQ ID NO: 11513 - DNA, 10 bp, Saccharomyces cerevisiae
tgtgcgaaaa

SEQ ID NO: 11514 - DNA, 10 bp, Saccharomyces cerevisiae
tgtgcttgat

SEQ ID NO: 11515 - DNA, 10 bp, Saccharomyces cerevisiae
tgtggatatg

SEQ ID NO: 11516 - DNA, 10 bp, Saccharomyces cerevisiae
tgtggattcc

SEQ ID NO: 11517 - DNA, 10 bp, Saccharomyces cerevisiae
tgtggctcga

SEQ ID NO: 11518 - DNA, 10 bp, Saccharomyces cerevisiae
tgtgggaaac

SEQ ID NO: 11519 - DNA, 10 bp, Saccharomyces cerevisiae
tgtgggtgta

SEQ ID NO: 11520 - DNA, 10 bp, Saccharomyces cerevisiae
tgtggtcact

SEQ ID NO: 11521 - DNA, 10 bp, Saccharomyces cerevisiae
tgtgtaagaa

SEQ ID NO: 11522 - DNA, 10 bp, Saccharomyces cerevisiae
tgtgtagtct

SEQ ID NO: 11523 - DNA, 10 bp, Saccharomyces cerevisiae
tgtgtatatt

SEQ ID NO: 11524 - DNA, 10 bp, Saccharomyces cerevisiae
tgtgtatgga

SEQ ID NO: 11525 - DNA, 10 bp, Saccharomyces cerevisiae
tgtgtattta

SEQ ID NO: 11526 - DNA, 10 bp, Saccharomyces cerevisiae
tgtgtcgttg

SEQ ID NO: 11527 - DNA, 10 bp, Saccharomyces cerevisiae
tgtgtcttac

SEQ ID NO: 11528 - DNA, 10 bp, Saccharomyces cerevisiae
tgtgttaata

SEQ ID NO: 11529 - DNA, 10 bp, Saccharomyces cerevisiae
tgtgtttacc

SEQ ID NO: 11530 - DNA, 10 bp, Saccharomyces cerevisiae
tgttaaagca

SEQ ID NO: 11531 - DNA, 10 bp, Saccharomyces cerevisiae
tgttaaccga

SEQ ID NO: 11532 - DNA, 10 bp, Saccharomyces cerevisiae
tgttaagtag

SEQ ID NO: 11533 - DNA, 10 bp, Saccharomyces cerevisiae
tgttaattag

SEQ ID NO: 11534 - DNA, 10 bp, Saccharomyces cerevisiae
tgttatagtt

SEQ ID NO: 11535 - DNA, 10 bp, Saccharomyces cerevisiae
tgttatgata

SEQ ID NO: 11536 - DNA, 10 bp, Saccharomyces cerevisiae
tgttcaaaaa

SEQ ID NO: 11537 - DNA, 10 bp, Saccharomyces cerevisiae
tgttcaagag

SEQ ID NO: 11538 - DNA, 10 bp, Saccharomyces cerevisiae
tgttcacctg

SEQ ID NO: 11539 - DNA, 10 bp, Saccharomyces cerevisiae
tgttccaaaa

SEQ ID NO: 11540 - DNA, 10 bp, Saccharomyces cerevisiae
tgttccactt

SEQ ID NO: 11541 - DNA, 10 bp, Saccharomyces cerevisiae
tgttccgttg

SEQ ID NO: 11542 - DNA, 10 bp, Saccharomyces cerevisiae
tgttctttaa

SEQ ID NO: 11543 - DNA, 10 bp, Saccharomyces cerevisiae
tgttgaactg

SEQ ID NO: 11544 - DNA, 10 bp, Saccharomyces cerevisiae
tgttgctaaa

SEQ ID NO: 11545 - DNA, 10 bp, Saccharomyces cerevisiae
tgttggaggg

SEQ ID NO: 11546 - DNA, 10 bp, Saccharomyces cerevisiae
tgttggtttg

SEQ ID NO: 11547 - DNA, 10 bp, Saccharomyces cerevisiae
tgttgtattg

SEQ ID NO: 11548 - DNA, 10 bp, Saccharomyces cerevisiae
tgttgtcgga

SEQ ID NO: 11549 - DNA, 10 bp, Saccharomyces cerevisiae
tgttgtggac

SEQ ID NO: 11550 - DNA, 10 bp, Saccharomyces cerevisiae
tgtttacttt

SEQ ID NO: 11551 - DNA, 10 bp, Saccharomyces cerevisiae
tgtttcccca

SEQ ID NO: 11552 - DNA, 10 bp, Saccharomyces cerevisiae
tgtttcgata

SEQ ID NO: 11553 - DNA, 10 bp, Saccharomyces cerevisiae
tgtttggttc

SEQ ID NO: 11554 - DNA, 10 bp, Saccharomyces cerevisiae
tgtttgtttg

SEQ ID NO: 11555 - DNA, 10 bp, Saccharomyces cerevisiae
tgttttcaga

SEQ ID NO: 11556 - DNA, 10 bp, Saccharomyces cerevisiae
tgttttcccg

SEQ ID NO: 11557 - DNA, 10 bp, Saccharomyces cerevisiae
tgttttcttg

SEQ ID NO: 11558 - DNA, 10 bp, Saccharomyces cerevisiae
tgttttgaaa

SEQ ID NO: 11559 - DNA, 10 bp, Saccharomyces cerevisiae
tgtttttcag

SEQ ID NO: 11560 - DNA, 10 bp, Saccharomyces cerevisiae
tgtttttgat

SEQ ID NO: 11561 - DNA, 10 bp, Saccharomyces cerevisiae
tgtttttgga

SEQ ID NO: 11562 - DNA, 10 bp, Saccharomyces cerevisiae
tgtttttttg

SEQ ID NO: 11563 - DNA, 10 bp, Saccharomyces cerevisiae
ttaaaaagtt

SEQ ID NO: 11564 - DNA, 10 bp, Saccharomyces cerevisiae
ttaaaacgaa

SEQ ID NO: 11565 - DNA, 10 bp, Saccharomyces cerevisiae
ttaaaataaa

SEQ ID NO: 11566 - DNA, 10 bp, Saccharomyces cerevisiae
ttaaaatatg

SEQ ID NO: 11567 - DNA, 10 bp, Saccharomyces cerevisiae
ttaaaatggg

SEQ ID NO: 11568 - DNA, 10 bp, Saccharomyces cerevisiae
ttaaaccctt

SEQ ID NO: 11569 - DNA, 10 bp, Saccharomyces cerevisiae
ttaaacggta

SEQ ID NO: 11570 - DNA, 10 bp, Saccharomyces cerevisiae
ttaaacggtt

SEQ ID NO: 11571 - DNA, 10 bp, Saccharomyces cerevisiae
ttaaactacc

SEQ ID NO: 11572 - DNA, 10 bp, Saccharomyces cerevisiae
ttaaactgag

SEQ ID NO: 11573 - DNA, 10 bp, Saccharomyces cerevisiae
ttaaagaaaa

SEQ ID NO: 11574 - DNA, 10 bp, Saccharomyces cerevisiae
ttaaagtttt

SEQ ID NO: 11575 - DNA, 10 bp, Saccharomyces cerevisiae
ttaaattcat

SEQ ID NO: 11576 - DNA, 10 bp, Saccharomyces cerevisiae
ttaaattttt

SEQ ID NO: 11577 - DNA, 10 bp, Saccharomyces cerevisiae
ttaacaacaa

SEQ ID NO: 11578 - DNA, 10 bp, Saccharomyces cerevisiae
ttaacaacta

SEQ ID NO: 11579 - DNA, 10 bp, Saccharomyces cerevisiae
ttaacgaagc

SEQ ID NO: 11580 - DNA, 10 bp, Saccharomyces cerevisiae
ttaacggcca

SEQ ID NO: 11581 - DNA, 10 bp, Saccharomyces cerevisiae
ttaacggccg

SEQ ID NO: 11582 - DNA, 10 bp, Saccharomyces cerevisiae
ttaacggctg

SEQ ID NO: 11583 - DNA, 10 bp, Saccharomyces cerevisiae
ttaacttggc

SEQ ID NO: 11584 - DNA, 10 bp, Saccharomyces cerevisiae
ttaacttttt

SEQ ID NO: 11585 - DNA, 10 bp, Saccharomyces cerevisiae
ttaagccatc

SEQ ID NO: 11586 - DNA, 10 bp, Saccharomyces cerevisiae
ttaagcgcct

SEQ ID NO: 11587 - DNA, 10 bp, Saccharomyces cerevisiae
ttaagctatc

SEQ ID NO: 11588 - DNA, 10 bp, Saccharomyces cerevisiae
ttaaggttta

SEQ ID NO: 11589 - DNA, 10 bp, Saccharomyces cerevisiae
ttaagtaact

SEQ ID NO: 11590 - DNA, 10 bp, Saccharomyces cerevisiae
ttaagtatcg

SEQ ID NO: 11591 - DNA, 10 bp, Saccharomyces cerevisiae
ttaagtcacg

SEQ ID NO: 11592 - DNA, 10 bp, Saccharomyces cerevisiae
ttaagtgaat

SEQ ID NO: 11593 - DNA, 10 bp, Saccharomyces cerevisiae
ttaagttttc

SEQ ID NO: 11594 - DNA, 10 bp, Saccharomyces cerevisiae
ttaataatca

SEQ ID NO: 11595 - DNA, 10 bp, Saccharomyces cerevisiae
ttaatgacct

SEQ ID NO: 11596 - DNA, 10 bp, Saccharomyces cerevisiae
ttaatggtat

SEQ ID NO: 11597 - DNA, 10 bp, Saccharomyces cerevisiae
ttaattagag

SEQ ID NO: 11598 - DNA, 10 bp, Saccharomyces cerevisiae
ttaattagtt

SEQ ID NO: 11599 - DNA, 10 bp, Saccharomyces cerevisiae
ttaattatgg

SEQ ID NO: 11600 - DNA, 10 bp, Saccharomyces cerevisiae
ttaatttcca

SEQ ID NO: 11601 - DNA, 10 bp, Saccharomyces cerevisiae
ttaattttat

SEQ ID NO: 11602 - DNA, 10 bp, Saccharomyces cerevisiae
ttacaaaaaa

SEQ ID NO: 11603 - DNA, 10 bp, Saccharomyces cerevisiae
ttacaatcgg

SEQ ID NO: 11604 - DNA, 10 bp, Saccharomyces cerevisiae
ttacaattaa

SEQ ID NO: 11605 - DNA, 10 bp, Saccharomyces cerevisiae
ttacaggttg

SEQ ID NO: 11606 - DNA, 10 bp, Saccharomyces cerevisiae
ttaccaagtc

SEQ ID NO: 11607 - DNA, 10 bp, Saccharomyces cerevisiae
ttacctgaat

SEQ ID NO: 11608 - DNA, 10 bp, Saccharomyces cerevisiae
ttacgcacat

SEQ ID NO: 11609 - DNA, 10 bp, Saccharomyces cerevisiae
ttacggtgcc

SEQ ID NO: 11610 - DNA, 10 bp, Saccharomyces cerevisiae
ttactaaaaa

SEQ ID NO: 11611 - DNA, 10 bp, Saccharomyces cerevisiae
ttactaacat

SEQ ID NO: 11612 - DNA, 10 bp, Saccharomyces cerevisiae
ttactagcct

SEQ ID NO: 11613 - DNA, 10 bp, Saccharomyces cerevisiae
ttactagtat

SEQ ID NO: 11614 - DNA, 10 bp, Saccharomyces cerevisiae
ttactgaggg

SEQ ID NO: 11615 - DNA, 10 bp, Saccharomyces cerevisiae
ttactgcaat

SEQ ID NO: 11616 - DNA, 10 bp, Saccharomyces cerevisiae
ttactgtaac

SEQ ID NO: 11617 - DNA, 10 bp, Saccharomyces cerevisiae
ttacttcggc

SEQ ID NO: 11618 - DNA, 10 bp, Saccharomyces cerevisiae
ttactttcta

SEQ ID NO: 11619 - DNA, 10 bp, Saccharomyces cerevisiae
ttacttttga

SEQ ID NO: 11620 - DNA, 10 bp, Saccharomyces cerevisiae
ttacttttta

SEQ ID NO: 11621 - DNA, 10 bp, Saccharomyces cerevisiae
ttagaaagcc

SEQ ID NO: 11622 - DNA, 10 bp, Saccharomyces cerevisiae
ttagaataag

SEQ ID NO: 11623 - DNA, 10 bp, Saccharomyces cerevisiae
ttagaccttt

SEQ ID NO: 11624 - DNA, 10 bp, Saccharomyces cerevisiae
ttagacgcgg

SEQ ID NO: 11625 - DNA, 10 bp, Saccharomyces cerevisiae
ttagaggttg

SEQ ID NO: 11626 - DNA, 10 bp, Saccharomyces cerevisiae
ttagagtcaa

SEQ ID NO: 11627 - DNA, 10 bp, Saccharomyces cerevisiae
ttagatattc

SEQ ID NO: 11628 - DNA, 10 bp, Saccharomyces cerevisiae
ttagatgaag

SEQ ID NO: 11629 - DNA, 10 bp, Saccharomyces cerevisiae
ttagatttat

SEQ ID NO: 11630 - DNA, 10 bp, Saccharomyces cerevisiae
ttagcaatat

SEQ ID NO: 11631 - DNA, 10 bp, Saccharomyces cerevisiae
ttagccctat

SEQ ID NO: 11632 - DNA, 10 bp, Saccharomyces cerevisiae
ttagcgaaat

SEQ ID NO: 11633 - DNA, 10 bp, Saccharomyces cerevisiae
ttagctgcca

SEQ ID NO: 11634 - DNA, 10 bp, Saccharomyces cerevisiae
ttagctgctg

SEQ ID NO: 11635 - DNA, 10 bp, Saccharomyces cerevisiae
ttagcttcta

SEQ ID NO: 11636 - DNA, 10 bp, Saccharomyces cerevisiae
ttaggaagtt

SEQ ID NO: 11637 - DNA, 10 bp, Saccharomyces cerevisiae
ttaggttcta

SEQ ID NO: 11638 - DNA, 10 bp, Saccharomyces cerevisiae
ttagtagaat

SEQ ID NO: 11639 - DNA, 10 bp, Saccharomyces cerevisiae
ttagtctcta

SEQ ID NO: 11640 - DNA, 10 bp, Saccharomyces cerevisiae
ttagtctgac

SEQ ID NO: 11641 - DNA, 10 bp, Saccharomyces cerevisiae
ttagtgaaaa

SEQ ID NO: 11642 - DNA, 10 bp, Saccharomyces cerevisiae
ttagtgaaga

SEQ ID NO: 11643 - DNA, 10 bp, Saccharomyces cerevisiae
ttagtgaata

SEQ ID NO: 11644 - DNA, 10 bp, Saccharomyces cerevisiae
ttagtgtcaa

SEQ ID NO: 11645 - DNA, 10 bp, Saccharomyces cerevisiae
ttagttcgaa

SEQ ID NO: 11646 - DNA, 10 bp, Saccharomyces cerevisiae
ttagtttata

SEQ ID NO: 11647 - DNA, 10 bp, Saccharomyces cerevisiae
ttagtttcaa

SEQ ID NO: 11648 - DNA, 10 bp, Saccharomyces cerevisiae
ttagtttcga

SEQ ID NO: 11649 - DNA, 10 bp, Saccharomyces cerevisiae
ttagtttctc

SEQ ID NO: 11650 - DNA, 10 bp, Saccharomyces cerevisiae
ttataagaag

SEQ ID NO: 11651 - DNA, 10 bp, Saccharomyces cerevisiae
ttataagaat

SEQ ID NO: 11652 - DNA, 10 bp, Saccharomyces cerevisiae
ttataagtca

SEQ ID NO: 11653 - DNA, 10 bp, Saccharomyces cerevisiae
ttataatgaa

SEQ ID NO: 11654 - DNA, 10 bp, Saccharomyces cerevisiae
ttataattga

SEQ ID NO: 11655 - DNA, 10 bp, Saccharomyces cerevisiae
ttatactatt

SEQ ID NO: 11656 - DNA, 10 bp, Saccharomyces cerevisiae
ttatagaatg

SEQ ID NO: 11657 - DNA, 10 bp, Saccharomyces cerevisiae
ttatagatgc

SEQ ID NO: 11658 - DNA, 10 bp, Saccharomyces cerevisiae
ttatagattt

SEQ ID NO: 11659 - DNA, 10 bp, Saccharomyces cerevisiae
ttatagtata

SEQ ID NO: 11660 - DNA, 10 bp, Saccharomyces cerevisiae
ttatagtgaa

SEQ ID NO: 11661 - DNA, 10 bp, Saccharomyces cerevisiae
ttatatatat

SEQ ID NO: 11662 - DNA, 10 bp, Saccharomyces cerevisiae
ttatattgac

SEQ ID NO: 11663 - DNA, 10 bp, Saccharomyces cerevisiae
ttatcaaaaa

SEQ ID NO: 11664 - DNA, 10 bp, Saccharomyces cerevisiae
ttatcaaagg

SEQ ID NO: 11665 - DNA, 10 bp, Saccharomyces cerevisiae
ttatcaaatg

SEQ ID NO: 11666 - DNA, 10 bp, Saccharomyces cerevisiae
ttatcataat

SEQ ID NO: 11667 - DNA, 10 bp, Saccharomyces cerevisiae
ttatcctttg

SEQ ID NO: 11668 - DNA, 10 bp, Saccharomyces cerevisiae
ttatcgtcaa

SEQ ID NO: 11669 - DNA, 10 bp, Saccharomyces cerevisiae
ttatcgtgtc

SEQ ID NO: 11670 - DNA, 10 bp, Saccharomyces cerevisiae
ttatcgtgtt

SEQ ID NO: 11671 - DNA, 10 bp, Saccharomyces cerevisiae
ttatcgttgg

SEQ ID NO: 11672 - DNA, 10 bp, Saccharomyces cerevisiae
ttatctataa

SEQ ID NO: 11673 - DNA, 10 bp, Saccharomyces cerevisiae
ttatctattt

SEQ ID NO: 11674 - DNA, 10 bp, Saccharomyces cerevisiae
ttatgaagga

SEQ ID NO: 11675 - DNA, 10 bp, Saccharomyces cerevisiae
ttatgcttag

SEQ ID NO: 11676 - DNA, 10 bp, Saccharomyces cerevisiae
ttatgctttc

SEQ ID NO: 11677 - DNA, 10 bp, Saccharomyces cerevisiae
ttatggagtg

SEQ ID NO: 11678 - DNA, 10 bp, Saccharomyces cerevisiae
ttatggatct

SEQ ID NO: 11679 - DNA, 10 bp, Saccharomyces cerevisiae
ttatggctat

SEQ ID NO: 11680 - DNA, 10 bp, Saccharomyces cerevisiae
ttatgggtgc

SEQ ID NO: 11681 - DNA, 10 bp, Saccharomyces cerevisiae
ttatggtagg

SEQ ID NO: 11682 - DNA, 10 bp, Saccharomyces cerevisiae
ttattaaaaa

SEQ ID NO: 11683 - DNA, 10 bp, Saccharomyces cerevisiae
ttattaatga

SEQ ID NO: 11684 - DNA, 10 bp, Saccharomyces cerevisiae
ttattaccca

SEQ ID NO: 11685 - DNA, 10 bp, Saccharomyces cerevisiae
ttattatgcc

SEQ ID NO: 11686 - DNA, 10 bp, Saccharomyces cerevisiae
ttattcaaga

SEQ ID NO: 11687 - DNA, 10 bp, Saccharomyces cerevisiae
ttattcgcca

SEQ ID NO: 11688 - DNA, 10 bp, Saccharomyces cerevisiae
ttattgaggc

SEQ ID NO: 11689 - DNA, 10 bp, Saccharomyces cerevisiae
ttattgatat

SEQ ID NO: 11690 - DNA, 10 bp, Saccharomyces cerevisiae
ttattgatgc

SEQ ID NO: 11691 - DNA, 10 bp, Saccharomyces cerevisiae
ttatttcggt

SEQ ID NO: 11692 - DNA, 10 bp, Saccharomyces cerevisiae
ttatttcttt

SEQ ID NO: 11693 - DNA, 10 bp, Saccharomyces cerevisiae
ttattttgcc

SEQ ID NO: 11694 - DNA, 10 bp, Saccharomyces cerevisiae
ttatttttca

SEQ ID NO: 11695 - DNA, 10 bp, Saccharomyces cerevisiae
ttatttttgc

SEQ ID NO: 11696 - DNA, 10 bp, Saccharomyces cerevisiae
ttcaaaaaaa

SEQ ID NO: 11697 - DNA, 10 bp, Saccharomyces cerevisiae
ttcaaaaatc

SEQ ID NO: 11698 - DNA, 10 bp, Saccharomyces cerevisiae
ttcaaaagac

SEQ ID NO: 11699 - DNA, 10 bp, Saccharomyces cerevisiae
ttcaaaagag

SEQ ID NO: 11700 - DNA, 10 bp, Saccharomyces cerevisiae
ttcaaaagca

SEQ ID NO: 11701 - DNA, 10 bp, Saccharomyces cerevisiae
ttcaaaagga

SEQ ID NO: 11702 - DNA, 10 bp, Saccharomyces cerevisiae
ttcaacaagg

SEQ ID NO: 11703 - DNA, 10 bp, Saccharomyces cerevisiae
ttcaaccagt

SEQ ID NO: 11704 - DNA, 10 bp, Saccharomyces cerevisiae
ttcaagactc

SEQ ID NO: 11705 - DNA, 10 bp, Saccharomyces cerevisiae
ttcaagcccc

SEQ ID NO: 11706 - DNA, 10 bp, Saccharomyces cerevisiae
ttcaaggaga

SEQ ID NO: 11707 - DNA, 10 bp, Saccharomyces cerevisiae
ttcaagtaaa

SEQ ID NO: 11708 - DNA, 10 bp, Saccharomyces cerevisiae
ttcaagttgc

SEQ ID NO: 11709 - DNA, 10 bp, Saccharomyces cerevisiae
ttcaattctt

SEQ ID NO: 11710 - DNA, 10 bp, Saccharomyces cerevisiae
ttcacaatgc

SEQ ID NO: 11711 - DNA, 10 bp, Saccharomyces cerevisiae
ttcacataag

SEQ ID NO: 11712 - DNA, 10 bp, Saccharomyces cerevisiae
ttcaccaatt

SEQ ID NO: 11713 - DNA, 10 bp, Saccharomyces cerevisiae
ttcacccaac

SEQ ID NO: 11714 - DNA, 10 bp, Saccharomyces cerevisiae
ttcacctaag

SEQ ID NO: 11715 - DNA, 10 bp, Saccharomyces cerevisiae
ttcactgaat

SEQ ID NO: 11716 - DNA, 10 bp, Saccharomyces cerevisiae
ttcacttaac

SEQ ID NO: 11717 - DNA, 10 bp, Saccharomyces cerevisiae
ttcactttca

SEQ ID NO: 11718 - DNA, 10 bp, Saccharomyces cerevisiae
ttcacttttt

SEQ ID NO: 11719 - DNA, 10 bp, Saccharomyces cerevisiae
ttcagaaaaa

SEQ ID NO: 11720 - DNA, 10 bp, Saccharomyces cerevisiae
ttcagaaagg

SEQ ID NO: 11721 - DNA, 10 bp, Saccharomyces cerevisiae
ttcagcggat

SEQ ID NO: 11722 - DNA, 10 bp, Saccharomyces cerevisiae
ttcagcttga

SEQ ID NO: 11723 - DNA, 10 bp, Saccharomyces cerevisiae
ttcaggaaaa

SEQ ID NO: 11724 - DNA, 10 bp, Saccharomyces cerevisiae
ttcaggtcac

SEQ ID NO: 11725 - DNA, 10 bp, Saccharomyces cerevisiae
ttcaggtttt

SEQ ID NO: 11726 - DNA, 10 bp, Saccharomyces cerevisiae
ttcagtgaaa

SEQ ID NO: 11727 - DNA, 10 bp, Saccharomyces cerevisiae
ttcagttcga

SEQ ID NO: 11728 - DNA, 10 bp, Saccharomyces cerevisiae
ttcataagga

SEQ ID NO: 11729 - DNA, 10 bp, Saccharomyces cerevisiae
ttcataccaa

SEQ ID NO: 11730 - DNA, 10 bp, Saccharomyces cerevisiae
ttcattcact

SEQ ID NO: 11731 - DNA, 10 bp, Saccharomyces cerevisiae
ttcattctct

SEQ ID NO: 11732 - DNA, 10 bp, Saccharomyces cerevisiae
ttccaaatat

SEQ ID NO: 11733 - DNA, 10 bp, Saccharomyces cerevisiae
ttccaataaa

SEQ ID NO: 11734 - DNA, 10 bp, Saccharomyces cerevisiae
ttccaatgat

SEQ ID NO: 11735 - DNA, 10 bp, Saccharomyces cerevisiae
ttccacaatt

SEQ ID NO: 11736 - DNA, 10 bp, Saccharomyces cerevisiae
ttccactcct

SEQ ID NO: 11737 - DNA, 10 bp, Saccharomyces cerevisiae
ttccactttg

SEQ ID NO: 11738 - DNA, 10 bp, Saccharomyces cerevisiae
ttccagcacc

SEQ ID NO: 11739 - DNA, 10 bp, Saccharomyces cerevisiae
ttccagtaac

SEQ ID NO: 11740 - DNA, 10 bp, Saccharomyces cerevisiae
ttccatatag

SEQ ID NO: 11741 - DNA, 10 bp, Saccharomyces cerevisiae
ttccatctga

SEQ ID NO: 11742 - DNA, 10 bp, Saccharomyces cerevisiae
ttcccacact

SEQ ID NO: 11743 - DNA, 10 bp, Saccharomyces cerevisiae
ttcccagaat

SEQ ID NO: 11744 - DNA, 10 bp, Saccharomyces cerevisiae
ttccccaagt

SEQ ID NO: 11745 - DNA, 10 bp, Saccharomyces cerevisiae
ttccccaata

SEQ ID NO: 11746 - DNA, 10 bp, Saccharomyces cerevisiae
ttccccacta

SEQ ID NO: 11747 - DNA, 10 bp, Saccharomyces cerevisiae
ttccccttac

SEQ ID NO: 11748 - DNA, 10 bp, Saccharomyces cerevisiae
ttcccctttt

SEQ ID NO: 11749 - DNA, 10 bp, Saccharomyces cerevisiae
ttcccgcgga

SEQ ID NO: 11750 - DNA, 10 bp, Saccharomyces cerevisiae
ttccgagatc

SEQ ID NO: 11751 - DNA, 10 bp, Saccharomyces cerevisiae
ttccgattaa

SEQ ID NO: 11752 - DNA, 10 bp, Saccharomyces cerevisiae
ttcctaaaaa

SEQ ID NO: 11753 - DNA, 10 bp, Saccharomyces cerevisiae
ttcctaattt

SEQ ID NO: 11754 - DNA, 10 bp, Saccharomyces cerevisiae
ttcctcgcct

SEQ ID NO: 11755 - DNA, 10 bp, Saccharomyces cerevisiae
ttcctctaaa

SEQ ID NO: 11756 - DNA, 10 bp, Saccharomyces cerevisiae
ttcctgaccg

SEQ ID NO: 11757 - DNA, 10 bp, Saccharomyces cerevisiae
ttcctgtgtg

SEQ ID NO: 11758 - DNA, 10 bp, Saccharomyces cerevisiae
ttcctttcct

SEQ ID NO: 11759 - DNA, 10 bp, Saccharomyces cerevisiae
ttcgaattag

SEQ ID NO: 11760 - DNA, 10 bp, Saccharomyces cerevisiae
ttcgagacaa

SEQ ID NO: 11761 - DNA, 10 bp, Saccharomyces cerevisiae
ttcgagtttg

SEQ ID NO: 11762 - DNA, 10 bp, Saccharomyces cerevisiae
ttcgatccaa

SEQ ID NO: 11763 - DNA, 10 bp, Saccharomyces cerevisiae
ttcgatcttt

SEQ ID NO: 11764 - DNA, 10 bp, Saccharomyces cerevisiae
ttcgcaactt

SEQ ID NO: 11765 - DNA, 10 bp, Saccharomyces cerevisiae
ttcgctagaa

SEQ ID NO: 11766 - DNA, 10 bp, Saccharomyces cerevisiae
ttcgctgatt

SEQ ID NO: 11767 - DNA, 10 bp, Saccharomyces cerevisiae
ttcgctgtcc

SEQ ID NO: 11768 - DNA, 10 bp, Saccharomyces cerevisiae
ttcgcttttt

SEQ ID NO: 11769 - DNA, 10 bp, Saccharomyces cerevisiae
ttcggagatt

SEQ ID NO: 11770 - DNA, 10 bp, Saccharomyces cerevisiae
ttcggcggtc

SEQ ID NO: 11771 - DNA, 10 bp, Saccharomyces cerevisiae
ttcgggccac

SEQ ID NO: 11772 - DNA, 10 bp, Saccharomyces cerevisiae
ttcggggtca

SEQ ID NO: 11773 - DNA, 10 bp, Saccharomyces cerevisiae
ttcgggtcca

SEQ ID NO: 11774 - DNA, 10 bp, Saccharomyces cerevisiae
ttcgggtctc

SEQ ID NO: 11775 - DNA, 10 bp, Saccharomyces cerevisiae
ttcgtagtag

SEQ ID NO: 11776 - DNA, 10 bp, Saccharomyces cerevisiae
ttcgtattac

SEQ ID NO: 11777 - DNA, 10 bp, Saccharomyces cerevisiae
ttcgtgatcc

SEQ ID NO: 11778 - DNA, 10 bp, Saccharomyces cerevisiae
ttcgttaact

SEQ ID NO: 11779 - DNA, 10 bp, Saccharomyces cerevisiae
ttcgttcaca

SEQ ID NO: 11780 - DNA, 10 bp, Saccharomyces cerevisiae
ttcgttcatt

SEQ ID NO: 11781 - DNA, 10 bp, Saccharomyces cerevisiae
ttcgttccct

SEQ ID NO: 11782 - DNA, 10 bp, Saccharomyces cerevisiae
ttctaatata

SEQ ID NO: 11783 - DNA, 10 bp, Saccharomyces cerevisiae
ttctacaaca

SEQ ID NO: 11784 - DNA, 10 bp, Saccharomyces cerevisiae
ttctatgctt

SEQ ID NO: 11785 - DNA, 10 bp, Saccharomyces cerevisiae
ttctatgtct

SEQ ID NO: 11786 - DNA, 10 bp, Saccharomyces cerevisiae
ttctattagc

SEQ ID NO: 11787 - DNA, 10 bp, Saccharomyces cerevisiae
ttctattgga

SEQ ID NO: 11788 - DNA, 10 bp, Saccharomyces cerevisiae
ttctatttaa

SEQ ID NO: 11789 - DNA, 10 bp, Saccharomyces cerevisiae
ttctcgtact

SEQ ID NO: 11790 - DNA, 10 bp, Saccharomyces cerevisiae
ttctctaaga

SEQ ID NO: 11791 - DNA, 10 bp, Saccharomyces cerevisiae
ttctcttcac

SEQ ID NO: 11792 - DNA, 10 bp, Saccharomyces cerevisiae
ttctgatgag

SEQ ID NO: 11793 - DNA, 10 bp, Saccharomyces cerevisiae
ttctgatgtt

SEQ ID NO: 11794 - DNA, 10 bp, Saccharomyces cerevisiae
ttctgcaagt

SEQ ID NO: 11795 - DNA, 10 bp, Saccharomyces cerevisiae
ttctgcagtc

SEQ ID NO: 11796 - DNA, 10 bp, Saccharomyces cerevisiae
ttctgctatc

SEQ ID NO: 11797 - DNA, 10 bp, Saccharomyces cerevisiae
ttctgcttaa

SEQ ID NO: 11798 - DNA, 10 bp, Saccharomyces cerevisiae
ttctgcttag

SEQ ID NO: 11799 - DNA, 10 bp, Saccharomyces cerevisiae
ttctgtacaa

SEQ ID NO: 11800 - DNA, 10 bp, Saccharomyces cerevisiae
ttctgttgca

SEQ ID NO: 11801 - DNA, 10 bp, Saccharomyces cerevisiae
ttcttaatgg

SEQ ID NO: 11802 - DNA, 10 bp, Saccharomyces cerevisiae
ttcttagaca

SEQ ID NO: 11803 - DNA, 10 bp, Saccharomyces cerevisiae
ttcttataca

SEQ ID NO: 11804 - DNA, 10 bp, Saccharomyces cerevisiae
ttcttctacc

SEQ ID NO: 11805 - DNA, 10 bp, Saccharomyces cerevisiae
ttcttgatta

SEQ ID NO: 11806 - DNA, 10 bp, Saccharomyces cerevisiae
ttctttctga

SEQ ID NO: 11807 - DNA, 10 bp, Saccharomyces cerevisiae
ttctttgcag

SEQ ID NO: 11808 - DNA, 10 bp, Saccharomyces cerevisiae
ttgaaagaaa

SEQ ID NO: 11809 - DNA, 10 bp, Saccharomyces cerevisiae
ttgaaagaga

SEQ ID NO: 11810 - DNA, 10 bp, Saccharomyces cerevisiae
ttgaaatagt

SEQ ID NO: 11811 - DNA, 10 bp, Saccharomyces cerevisiae
ttgaaatgtg

SEQ ID NO: 11812 - DNA, 10 bp, Saccharomyces cerevisiae
ttgaaattta

SEQ ID NO: 11813 - DNA, 10 bp, Saccharomyces cerevisiae
ttgaaatttc

SEQ ID NO: 11814 - DNA, 10 bp, Saccharomyces cerevisiae
ttgaactatc

SEQ ID NO: 11815 - DNA, 10 bp, Saccharomyces cerevisiae
ttgaactccc

SEQ ID NO: 11816 - DNA, 10 bp, Saccharomyces cerevisiae
ttgaacttcc

SEQ ID NO: 11817 - DNA, 10 bp, Saccharomyces cerevisiae
ttgaactttg

SEQ ID NO: 11818 - DNA, 10 bp, Saccharomyces cerevisiae
ttgaagacag

SEQ ID NO: 11819 - DNA, 10 bp, Saccharomyces cerevisiae
ttgaagatta

SEQ ID NO: 11820 - DNA, 10 bp, Saccharomyces cerevisiae
ttgaagcaga

SEQ ID NO: 11821 - DNA, 10 bp, Saccharomyces cerevisiae
ttgaaggatt

SEQ ID NO: 11822 - DNA, 10 bp, Saccharomyces cerevisiae
ttgaagggga

SEQ ID NO: 11823 - DNA, 10 bp, Saccharomyces cerevisiae
ttgaagttga

SEQ ID NO: 11824 - DNA, 10 bp, Saccharomyces cerevisiae
ttgaataacg

SEQ ID NO: 11825 - DNA, 10 bp, Saccharomyces cerevisiae
ttgaattttc

SEQ ID NO: 11826 - DNA, 10 bp, Saccharomyces cerevisiae
ttgacaaatg

SEQ ID NO: 11827 - DNA, 10 bp, Saccharomyces cerevisiae
ttgacaatcc

SEQ ID NO: 11828 - DNA, 10 bp, Saccharomyces cerevisiae
ttgacaatta

SEQ ID NO: 11829 - DNA, 10 bp, Saccharomyces cerevisiae
ttgacaggaa

SEQ ID NO: 11830 - DNA, 10 bp, Saccharomyces cerevisiae
ttgaccagtt

SEQ ID NO: 11831 - DNA, 10 bp, Saccharomyces cerevisiae
ttgacccgtg

SEQ ID NO: 11832 - DNA, 10 bp, Saccharomyces cerevisiae
ttgaccggag

SEQ ID NO: 11833 - DNA, 10 bp, Saccharomyces cerevisiae
ttgacctacc

SEQ ID NO: 11834 - DNA, 10 bp, Saccharomyces cerevisiae
ttgacggtaa

SEQ ID NO: 11835 - DNA, 10 bp, Saccharomyces cerevisiae
ttgacgtgca

SEQ ID NO: 11836 - DNA, 10 bp, Saccharomyces cerevisiae
ttgactaacc

SEQ ID NO: 11837 - DNA, 10 bp, Saccharomyces cerevisiae
ttgactaccc

SEQ ID NO: 11838 - DNA, 10 bp, Saccharomyces cerevisiae
ttgactccac

SEQ ID NO: 11839 - DNA, 10 bp, Saccharomyces cerevisiae
ttgactcgcc

SEQ ID NO: 11840 - DNA, 10 bp, Saccharomyces cerevisiae
ttgactttct

SEQ ID NO: 11841 - DNA, 10 bp, Saccharomyces cerevisiae
ttgagaaatg

SEQ ID NO: 11842 - DNA, 10 bp, Saccharomyces cerevisiae
ttgagaacgt

SEQ ID NO: 11843 - DNA, 10 bp, Saccharomyces cerevisiae
ttgagaactc

SEQ ID NO: 11844 - DNA, 10 bp, Saccharomyces cerevisiae
ttgagctacc

SEQ ID NO: 11845 - DNA, 10 bp, Saccharomyces cerevisiae
ttgataccgt

SEQ ID NO: 11846 - DNA, 10 bp, Saccharomyces cerevisiae
ttgataggtt

SEQ ID NO: 11847 - DNA, 10 bp, Saccharomyces cerevisiae
ttgatatcaa

SEQ ID NO: 11848 - DNA, 10 bp, Saccharomyces cerevisiae
ttgatatgct

SEQ ID NO: 11849 - DNA, 10 bp, Saccharomyces cerevisiae
ttgatcacgg

SEQ ID NO: 11850 - DNA, 10 bp, Saccharomyces cerevisiae
ttgatcccgt

SEQ ID NO: 11851 - DNA, 10 bp, Saccharomyces cerevisiae
ttgatctcat

SEQ ID NO: 11852 - DNA, 10 bp, Saccharomyces cerevisiae
ttgatgccag

SEQ ID NO: 11853 - DNA, 10 bp, Saccharomyces cerevisiae
ttgatggttt

SEQ ID NO: 11854 - DNA, 10 bp, Saccharomyces cerevisiae
ttgatgtgat

SEQ ID NO: 11855 - DNA, 10 bp, Saccharomyces cerevisiae
ttgatgttat

SEQ ID NO: 11856 - DNA, 10 bp, Saccharomyces cerevisiae
ttgatgttga

SEQ ID NO: 11857 - DNA, 10 bp, Saccharomyces cerevisiae
ttgattttga

SEQ ID NO: 11858 - DNA, 10 bp, Saccharomyces cerevisiae
ttgcaaacga

SEQ ID NO: 11859 - DNA, 10 bp, Saccharomyces cerevisiae
ttgcaaggca

SEQ ID NO: 11860 - DNA, 10 bp, Saccharomyces cerevisiae
ttgcaataga

SEQ ID NO: 11861 - DNA, 10 bp, Saccharomyces cerevisiae
ttgcaatatc

SEQ ID NO: 11862 - DNA, 10 bp, Saccharomyces cerevisiae
ttgcacacag

SEQ ID NO: 11863 - DNA, 10 bp, Saccharomyces cerevisiae
ttgcacaggc

SEQ ID NO: 11864 - DNA, 10 bp, Saccharomyces cerevisiae
ttgcacccac

SEQ ID NO: 11865 - DNA, 10 bp, Saccharomyces cerevisiae
ttgcagagat

SEQ ID NO: 11866 - DNA, 10 bp, Saccharomyces cerevisiae
ttgcaggtgg

SEQ ID NO: 11867 - DNA, 10 bp, Saccharomyces cerevisiae
ttgcagtaat

SEQ ID NO: 11868 - DNA, 10 bp, Saccharomyces cerevisiae
ttgcagtgat

SEQ ID NO: 11869 - DNA, 10 bp, Saccharomyces cerevisiae
ttgcatatgg

SEQ ID NO: 11870 - DNA, 10 bp, Saccharomyces cerevisiae
ttgcatccgg

SEQ ID NO: 11871 - DNA, 10 bp, Saccharomyces cerevisiae
ttgccaatct

SEQ ID NO: 11872 - DNA, 10 bp, Saccharomyces cerevisiae
ttgccactgg

SEQ ID NO: 11873 - DNA, 10 bp, Saccharomyces cerevisiae
ttgccaggct

SEQ ID NO: 11874 - DNA, 10 bp, Saccharomyces cerevisiae
ttgccattct

SEQ ID NO: 11875 - DNA, 10 bp, Saccharomyces cerevisiae
ttgcccagtc

SEQ ID NO: 11876 - DNA, 10 bp, Saccharomyces cerevisiae
ttgcccattt

SEQ ID NO: 11877 - DNA, 10 bp, Saccharomyces cerevisiae
ttgccccaca

SEQ ID NO: 11878 - DNA, 10 bp, Saccharomyces cerevisiae
ttgccggtct

SEQ ID NO: 11879 - DNA, 10 bp, Saccharomyces cerevisiae
ttgccgtaca

SEQ ID NO: 11880 - DNA, 10 bp, Saccharomyces cerevisiae
ttgccgtatc

SEQ ID NO: 11881 - DNA, 10 bp, Saccharomyces cerevisiae
ttgcctcagt

SEQ ID NO: 11882 - DNA, 10 bp, Saccharomyces cerevisiae
ttgcctcttt

SEQ ID NO: 11883 - DNA, 10 bp, Saccharomyces cerevisiae
ttgcgataga

SEQ ID NO: 11884 - DNA, 10 bp, Saccharomyces cerevisiae
ttgcgtcaat

SEQ ID NO: 11885 - DNA, 10 bp, Saccharomyces cerevisiae
ttgctaggca

SEQ ID NO: 11886 - DNA, 10 bp, Saccharomyces cerevisiae
ttgctagtct

SEQ ID NO: 11887 - DNA, 10 bp, Saccharomyces cerevisiae
ttgctccacc

SEQ ID NO: 11888 - DNA, 10 bp, Saccharomyces cerevisiae
ttgctctggg

SEQ ID NO: 11889 - DNA, 10 bp, Saccharomyces cerevisiae
ttgctctttg

SEQ ID NO: 11890 - DNA, 10 bp, Saccharomyces cerevisiae
ttgctgatct

SEQ ID NO: 11891 - DNA, 10 bp, Saccharomyces cerevisiae
ttgctggtga

SEQ ID NO: 11892 - DNA, 10 bp, Saccharomyces cerevisiae
ttgctgttgg

SEQ ID NO: 11893 - DNA, 10 bp, Saccharomyces cerevisiae
ttgcttcatt

SEQ ID NO: 11894 - DNA, 10 bp, Saccharomyces cerevisiae
ttgctttggg

SEQ ID NO: 11895 - DNA, 10 bp, Saccharomyces cerevisiae
ttggaaaaat

SEQ ID NO: 11896 - DNA, 10 bp, Saccharomyces cerevisiae
ttggaaaaga

SEQ ID NO: 11897 - DNA, 10 bp, Saccharomyces cerevisiae
ttggaactac

SEQ ID NO: 11898 - DNA, 10 bp, Saccharomyces cerevisiae
ttggaaggat

SEQ ID NO: 11899 - DNA, 10 bp, Saccharomyces cerevisiae
ttggaatttt

SEQ ID NO: 11900 - DNA, 10 bp, Saccharomyces cerevisiae
ttggacagga

SEQ ID NO: 11901 - DNA, 10 bp, Saccharomyces cerevisiae
ttggacccac

SEQ ID NO: 11902 - DNA, 10 bp, Saccharomyces cerevisiae
ttggaccttg

SEQ ID NO: 11903 - DNA, 10 bp, Saccharomyces cerevisiae
ttggagaaga

SEQ ID NO: 11904 - DNA, 10 bp, Saccharomyces cerevisiae
ttggagaatt

SEQ ID NO: 11905 - DNA, 10 bp, Saccharomyces cerevisiae
ttggagtaag

SEQ ID NO: 11906 - DNA, 10 bp, Saccharomyces cerevisiae
ttggatagcc

SEQ ID NO: 11907 - DNA, 10 bp, Saccharomyces cerevisiae
ttggatgtca

SEQ ID NO: 11908 - DNA, 10 bp, Saccharomyces cerevisiae
ttggattcgt

SEQ ID NO: 11909 - DNA, 10 bp, Saccharomyces cerevisiae
ttggatttta

SEQ ID NO: 11910 - DNA, 10 bp, Saccharomyces cerevisiae
ttggcaaacc

SEQ ID NO: 11911 - DNA, 10 bp, Saccharomyces cerevisiae
ttggcaaaga

SEQ ID NO: 11912 - DNA, 10 bp, Saccharomyces cerevisiae
ttggcaaggg

SEQ ID NO: 11913 - DNA, 10 bp, Saccharomyces cerevisiae
ttggcatctt

SEQ ID NO: 11914 - DNA, 10 bp, Saccharomyces cerevisiae
ttggccattc

SEQ ID NO: 11915 - DNA, 10 bp, Saccharomyces cerevisiae
ttggcccaac

SEQ ID NO: 11916 - DNA, 10 bp, Saccharomyces cerevisiae
ttggccccgg

SEQ ID NO: 11917 - DNA, 10 bp, Saccharomyces cerevisiae
ttggcccctc

SEQ ID NO: 11918 - DNA, 10 bp, Saccharomyces cerevisiae
ttggcctcgc

SEQ ID NO: 11919 - DNA, 10 bp, Saccharomyces cerevisiae
ttggcgatga

SEQ ID NO: 11920 - DNA, 10 bp, Saccharomyces cerevisiae
ttggcggaaa

SEQ ID NO: 11921 - DNA, 10 bp, Saccharomyces cerevisiae
ttggcggtta

SEQ ID NO: 11922 - DNA, 10 bp, Saccharomyces cerevisiae
ttggctgata

SEQ ID NO: 11923 - DNA, 10 bp, Saccharomyces cerevisiae
ttggcttctg

SEQ ID NO: 11924 - DNA, 10 bp, Saccharomyces cerevisiae
ttgggaaaaa

SEQ ID NO: 11925 - DNA, 10 bp, Saccharomyces cerevisiae
ttgggcacgc

SEQ ID NO: 11926 - DNA, 10 bp, Saccharomyces cerevisiae
ttgggcccca

SEQ ID NO: 11927 - DNA, 10 bp, Saccharomyces cerevisiae
ttgggctagg

SEQ ID NO: 11928 - DNA, 10 bp, Saccharomyces cerevisiae
ttggggaatt

SEQ ID NO: 11929 - DNA, 10 bp, Saccharomyces cerevisiae
ttggggttgg

SEQ ID NO: 11930 - DNA, 10 bp, Saccharomyces cerevisiae
ttgggtaaat

SEQ ID NO: 11931 - DNA, 10 bp, Saccharomyces cerevisiae
ttgggtagaa

SEQ ID NO: 11932 - DNA, 10 bp, Saccharomyces cerevisiae
ttgggttaga

SEQ ID NO: 11933 - DNA, 10 bp, Saccharomyces cerevisiae
ttggtaaatc

SEQ ID NO: 11934 - DNA, 10 bp, Saccharomyces cerevisiae
ttggtaacct

SEQ ID NO: 11935 - DNA, 10 bp, Saccharomyces cerevisiae
ttggtagtga

SEQ ID NO: 11936 - DNA, 10 bp, Saccharomyces cerevisiae
ttggtagtgt

SEQ ID NO: 11937 - DNA, 10 bp, Saccharomyces cerevisiae
ttggtataat

SEQ ID NO: 11938 - DNA, 10 bp, Saccharomyces cerevisiae
ttggtccagt

SEQ ID NO: 11939 - DNA, 10 bp, Saccharomyces cerevisiae
ttggtctttg

SEQ ID NO: 11940 - DNA, 10 bp, Saccharomyces cerevisiae
ttggtgcaga

SEQ ID NO: 11941 - DNA, 10 bp, Saccharomyces cerevisiae
ttggttttca

SEQ ID NO: 11942 - DNA, 10 bp, Saccharomyces cerevisiae
ttggttttgg

SEQ ID NO: 11943 - DNA, 10 bp, Saccharomyces cerevisiae
ttgtaagaag

SEQ ID NO: 11944 - DNA, 10 bp, Saccharomyces cerevisiae
ttgtaatacg

SEQ ID NO: 11945 - DNA, 10 bp, Saccharomyces cerevisiae
ttgtaatcta

SEQ ID NO: 11946 - DNA, 10 bp, Saccharomyces cerevisiae
ttgtaattac

SEQ ID NO: 11947 - DNA, 10 bp, Saccharomyces cerevisiae
ttgtaccagg

SEQ ID NO: 11948 - DNA, 10 bp, Saccharomyces cerevisiae
ttgtaccttt

SEQ ID NO: 11949 - DNA, 10 bp, Saccharomyces cerevisiae
ttgtactgaa

SEQ ID NO: 11950 - DNA, 10 bp, Saccharomyces cerevisiae
ttgtactttg

SEQ ID NO: 11951 - DNA, 10 bp, Saccharomyces cerevisiae
ttgtagtata

SEQ ID NO: 11952 - DNA, 10 bp, Saccharomyces cerevisiae
ttgtatcctt

SEQ ID NO: 11953 - DNA, 10 bp, Saccharomyces cerevisiae
ttgtattaag

SEQ ID NO: 11954 - DNA, 10 bp, Saccharomyces cerevisiae
ttgtcaaaat

SEQ ID NO: 11955 - DNA, 10 bp, Saccharomyces cerevisiae
ttgtcaaatt

SEQ ID NO: 11956 - DNA, 10 bp, Saccharomyces cerevisiae
ttgtcagagg

SEQ ID NO: 11957 - DNA, 10 bp, Saccharomyces cerevisiae
ttgtcattgg

SEQ ID NO: 11958 - DNA, 10 bp, Saccharomyces cerevisiae
ttgtccaaga

SEQ ID NO: 11959 - DNA, 10 bp, Saccharomyces cerevisiae
ttgtcccttt

SEQ ID NO: 11960 - DNA, 10 bp, Saccharomyces cerevisiae
ttgtccttgg

SEQ ID NO: 11961 - DNA, 10 bp, Saccharomyces cerevisiae
ttgtcggtgg

SEQ ID NO: 11962 - DNA, 10 bp, Saccharomyces cerevisiae
ttgtcgtgga

SEQ ID NO: 11963 - DNA, 10 bp, Saccharomyces cerevisiae
ttgtctatgg

SEQ ID NO: 11964 - DNA, 10 bp, Saccharomyces cerevisiae
ttgtctctgg

SEQ ID NO: 11965 - DNA, 10 bp, Saccharomyces cerevisiae
ttgtctcttc

SEQ ID NO: 11966 - DNA, 10 bp, Saccharomyces cerevisiae
ttgtctcttg

SEQ ID NO: 11967 - DNA, 10 bp, Saccharomyces cerevisiae
ttgtctttcg

SEQ ID NO: 11968 - DNA, 10 bp, Saccharomyces cerevisiae
ttgtctttga

SEQ ID NO: 11969 - DNA, 10 bp, Saccharomyces cerevisiae
ttgtgaagag

SEQ ID NO: 11970 - DNA, 10 bp, Saccharomyces cerevisiae
ttgtgaccac

SEQ ID NO: 11971 - DNA, 10 bp, Saccharomyces cerevisiae
ttgtgaggcg

SEQ ID NO: 11972 - DNA, 10 bp, Saccharomyces cerevisiae
ttgtgcgcac

SEQ ID NO: 11973 - DNA, 10 bp, Saccharomyces cerevisiae
ttgtggtagc

SEQ ID NO: 11974 - DNA, 10 bp, Saccharomyces cerevisiae
ttgtggtata

SEQ ID NO: 11975 - DNA, 10 bp, Saccharomyces cerevisiae
ttgtggtcgg

SEQ ID NO: 11976 - DNA, 10 bp, Saccharomyces cerevisiae
ttgtgttcaa

SEQ ID NO: 11977 - DNA, 10 bp, Saccharomyces cerevisiae
ttgttatttg

SEQ ID NO: 11978 - DNA, 10 bp, Saccharomyces cerevisiae
ttgttcaggt

SEQ ID NO: 11979 - DNA, 10 bp, Saccharomyces cerevisiae
ttgttccaca

SEQ ID NO: 11980 - DNA, 10 bp, Saccharomyces cerevisiae
ttgttcgtaa

SEQ ID NO: 11981 - DNA, 10 bp, Saccharomyces cerevisiae
ttgttcgtga

SEQ ID NO: 11982 - DNA, 10 bp, Saccharomyces cerevisiae
ttgttcgttt

SEQ ID NO: 11983 - DNA, 10 bp, Saccharomyces cerevisiae
ttgttctttt

SEQ ID NO: 11984 - DNA, 10 bp, Saccharomyces cerevisiae
ttgttgaaag

SEQ ID NO: 11985 - DNA, 10 bp, Saccharomyces cerevisiae
ttgtttaccc

SEQ ID NO: 11986 - DNA, 10 bp, Saccharomyces cerevisiae
tttaaaaatg

SEQ ID NO: 11987 - DNA, 10 bp, Saccharomyces cerevisiae
tttaaaacgg

SEQ ID NO: 11988 - DNA, 10 bp, Saccharomyces cerevisiae
tttaaaatca

SEQ ID NO: 11989 - DNA, 10 bp, Saccharomyces cerevisiae
tttaaaatgc

SEQ ID NO: 11990 - DNA, 10 bp, Saccharomyces cerevisiae
tttaaagatg

SEQ ID NO: 11991 - DNA, 10 bp, Saccharomyces cerevisiae
tttaaagtgg

SEQ ID NO: 11992 - DNA, 10 bp, Saccharomyces cerevisiae
tttaaatggt

SEQ ID NO: 11993 - DNA, 10 bp, Saccharomyces cerevisiae
tttaacactg

SEQ ID NO: 11994 - DNA, 10 bp, Saccharomyces cerevisiae
tttaacagct

SEQ ID NO: 11995 - DNA, 10 bp, Saccharomyces cerevisiae
tttaacagtc

SEQ ID NO: 11996 - DNA, 10 bp, Saccharomyces cerevisiae
tttaacatta

SEQ ID NO: 11997 - DNA, 10 bp, Saccharomyces cerevisiae
tttaactgaa

SEQ ID NO: 11998 - DNA, 10 bp, Saccharomyces cerevisiae
tttaacttgg

SEQ ID NO: 11999 - DNA, 10 bp, Saccharomyces cerevisiae
tttaactttt

SEQ ID NO: 12000 - DNA, 10 bp, Saccharomyces cerevisiae
tttaagatgg

SEQ ID NO: 12001 - DNA, 10 bp, Saccharomyces cerevisiae
tttaagattg

SEQ ID NO: 12002 - DNA, 10 bp, Saccharomyces cerevisiae
tttaagctgg

SEQ ID NO: 12003 - DNA, 10 bp, Saccharomyces cerevisiae
tttaataatc

SEQ ID NO: 12004 - DNA, 10 bp, Saccharomyces cerevisiae
tttaatatat

SEQ ID NO: 12005 - DNA, 10 bp, Saccharomyces cerevisiae
tttaatatct

SEQ ID NO: 12006 - DNA, 10 bp, Saccharomyces cerevisiae
tttaatattg

SEQ ID NO: 12007 - DNA, 10 bp, Saccharomyces cerevisiae
tttaatgaca

SEQ ID NO: 12008 - DNA, 10 bp, Saccharomyces cerevisiae
tttaattact

SEQ ID NO: 12009 - DNA, 10 bp, Saccharomyces cerevisiae
tttaatttgc

SEQ ID NO: 12010 - DNA, 10 bp, Saccharomyces cerevisiae
tttacaaatg

SEQ ID NO: 12011 - DNA, 10 bp, Saccharomyces cerevisiae
tttacataaa

SEQ ID NO: 12012 - DNA, 10 bp, Saccharomyces cerevisiae
tttacccagt

SEQ ID NO: 12013 - DNA, 10 bp, Saccharomyces cerevisiae
tttaccgatc

SEQ ID NO: 12014 - DNA, 10 bp, Saccharomyces cerevisiae
tttaccgcaa

SEQ ID NO: 12015 - DNA, 10 bp, Saccharomyces cerevisiae
tttaccgctt

SEQ ID NO: 12016 - DNA, 10 bp, Saccharomyces cerevisiae
tttaccggtt

SEQ ID NO: 12017 - DNA, 10 bp, Saccharomyces cerevisiae
tttacctgtt

SEQ ID NO: 12018 - DNA, 10 bp, Saccharomyces cerevisiae
tttacgaaga

SEQ ID NO: 12019 - DNA, 10 bp, Saccharomyces cerevisiae
tttacgatga

SEQ ID NO: 12020 - DNA, 10 bp, Saccharomyces cerevisiae
tttacgcccc

SEQ ID NO: 12021 - DNA, 10 bp, Saccharomyces cerevisiae
tttacgtatt

SEQ ID NO: 12022 - DNA, 10 bp, Saccharomyces cerevisiae
tttactactg

SEQ ID NO: 12023 - DNA, 10 bp, Saccharomyces cerevisiae
tttactatat

SEQ ID NO: 12024 - DNA, 10 bp, Saccharomyces cerevisiae
tttacttact

SEQ ID NO: 12025 - DNA, 10 bp, Saccharomyces cerevisiae
tttactttcg

SEQ ID NO: 12026 - DNA, 10 bp, Saccharomyces cerevisiae
tttagaagag

SEQ ID NO: 12027 - DNA, 10 bp, Saccharomyces cerevisiae
tttagaatgg

SEQ ID NO: 12028 - DNA, 10 bp, Saccharomyces cerevisiae
tttagatccg

SEQ ID NO: 12029 - DNA, 10 bp, Saccharomyces cerevisiae
tttagcagta

SEQ ID NO: 12030 - DNA, 10 bp, Saccharomyces cerevisiae
tttagccaat

SEQ ID NO: 12031 - DNA, 10 bp, Saccharomyces cerevisiae
tttagctacc

SEQ ID NO: 12032 - DNA, 10 bp, Saccharomyces cerevisiae
tttagtatct

SEQ ID NO: 12033 - DNA, 10 bp, Saccharomyces cerevisiae
tttagtattt

SEQ ID NO: 12034 - DNA, 10 bp, Saccharomyces cerevisiae
tttagtcaaa

SEQ ID NO: 12035 - DNA, 10 bp, Saccharomyces cerevisiae
tttagtgaga

SEQ ID NO: 12036 - DNA, 10 bp, Saccharomyces cerevisiae
tttatataat

SEQ ID NO: 12037 - DNA, 10 bp, Saccharomyces cerevisiae
tttatcacca

SEQ ID NO: 12038 - DNA, 10 bp, Saccharomyces cerevisiae
tttatctccc

SEQ ID NO: 12039 - DNA, 10 bp, Saccharomyces cerevisiae
tttatgataa

SEQ ID NO: 12040 - DNA, 10 bp, Saccharomyces cerevisiae
tttatgtgta

SEQ ID NO: 12041 - DNA, 10 bp, Saccharomyces cerevisiae
tttcaaagag

SEQ ID NO: 12042 - DNA, 10 bp, Saccharomyces cerevisiae
tttcaaaggg

SEQ ID NO: 12043 - DNA, 10 bp, Saccharomyces cerevisiae
tttcaacaag

SEQ ID NO: 12044 - DNA, 10 bp, Saccharomyces cerevisiae
tttcaactcg

SEQ ID NO: 12045 - DNA, 10 bp, Saccharomyces cerevisiae
tttcaagaaa

SEQ ID NO: 12046 - DNA, 10 bp, Saccharomyces cerevisiae
tttcaataaa

SEQ ID NO: 12047 - DNA, 10 bp, Saccharomyces cerevisiae
tttcacagga

SEQ ID NO: 12048 - DNA, 10 bp, Saccharomyces cerevisiae
tttcaccatc

SEQ ID NO: 12049 - DNA, 10 bp, Saccharomyces cerevisiae
tttcagcgtt

SEQ ID NO: 12050 - DNA, 10 bp, Saccharomyces cerevisiae
tttcaggaga

SEQ ID NO: 12051 - DNA, 10 bp, Saccharomyces cerevisiae
tttcaggcta

SEQ ID NO: 12052 - DNA, 10 bp, Saccharomyces cerevisiae
tttcataaat

SEQ ID NO: 12053 - DNA, 10 bp, Saccharomyces cerevisiae
tttcatcgaa

SEQ ID NO: 12054 - DNA, 10 bp, Saccharomyces cerevisiae
tttcattatc

SEQ ID NO: 12055 - DNA, 10 bp, Saccharomyces cerevisiae
tttcattgaa

SEQ ID NO: 12056 - DNA, 10 bp, Saccharomyces cerevisiae
tttccaactc

SEQ ID NO: 12057 - DNA, 10 bp, Saccharomyces cerevisiae
tttccaagtc

SEQ ID NO: 12058 - DNA, 10 bp, Saccharomyces cerevisiae
tttccagaag

SEQ ID NO: 12059 - DNA, 10 bp, Saccharomyces cerevisiae
tttcccgagt

SEQ ID NO: 12060 - DNA, 10 bp, Saccharomyces cerevisiae
tttccgcgct

SEQ ID NO: 12061 - DNA, 10 bp, Saccharomyces cerevisiae
tttccgcggc

SEQ ID NO: 12062 - DNA, 10 bp, Saccharomyces cerevisiae
tttccgctaa

SEQ ID NO: 12063 - DNA, 10 bp, Saccharomyces cerevisiae
tttcctagaa

SEQ ID NO: 12064 - DNA, 10 bp, Saccharomyces cerevisiae
tttcctatct

SEQ ID NO: 12065 - DNA, 10 bp, Saccharomyces cerevisiae
tttcctatga

SEQ ID NO: 12066 - DNA, 10 bp, Saccharomyces cerevisiae
tttcctgcgc

SEQ ID NO: 12067 - DNA, 10 bp, Saccharomyces cerevisiae
tttcctttta

SEQ ID NO: 12068 - DNA, 10 bp, Saccharomyces cerevisiae
tttcgccctc

SEQ ID NO: 12069 - DNA, 10 bp, Saccharomyces cerevisiae
tttcgggaac

SEQ ID NO: 12070 - DNA, 10 bp, Saccharomyces cerevisiae
tttcggtttt

SEQ ID NO: 12071 - DNA, 10 bp, Saccharomyces cerevisiae
tttcgtctcc

SEQ ID NO: 12072 - DNA, 10 bp, Saccharomyces cerevisiae
tttcgtggtg

SEQ ID NO: 12073 - DNA, 10 bp, Saccharomyces cerevisiae
tttctaagct

SEQ ID NO: 12074 - DNA, 10 bp, Saccharomyces cerevisiae
tttctactgg

SEQ ID NO: 12075 - DNA, 10 bp, Saccharomyces cerevisiae
tttctcaagg

SEQ ID NO: 12076 - DNA, 10 bp, Saccharomyces cerevisiae
tttctcattt

SEQ ID NO: 12077 - DNA, 10 bp, Saccharomyces cerevisiae
tttctgagtg

SEQ ID NO: 12078 - DNA, 10 bp, Saccharomyces cerevisiae
tttctgatgg

SEQ ID NO: 12079 - DNA, 10 bp, Saccharomyces cerevisiae
tttctgcccc

SEQ ID NO: 12080 - DNA, 10 bp, Saccharomyces cerevisiae
tttctggaca

SEQ ID NO: 12081 - DNA, 10 bp, Saccharomyces cerevisiae
tttctggtgg

SEQ ID NO: 12082 - DNA, 10 bp, Saccharomyces cerevisiae
tttctgtccg

SEQ ID NO: 12083 - DNA, 10 bp, Saccharomyces cerevisiae
tttcttagat

SEQ ID NO: 12084 - DNA, 10 bp, Saccharomyces cerevisiae
tttcttatcc

SEQ ID NO: 12085 - DNA, 10 bp, Saccharomyces cerevisiae
tttcttcgag

SEQ ID NO: 12086 - DNA, 10 bp, Saccharomyces cerevisiae
tttcttgtct

SEQ ID NO: 12087 - DNA, 10 bp, Saccharomyces cerevisiae
tttctttccc

SEQ ID NO: 12088 - DNA, 10 bp, Saccharomyces cerevisiae
tttctttgat

SEQ ID NO: 12089 - DNA, 10 bp, Saccharomyces cerevisiae
tttgaaaatg

SEQ ID NO: 12090 - DNA, 10 bp, Saccharomyces cerevisiae
tttgaagacg

SEQ ID NO: 12091 - DNA, 10 bp, Saccharomyces cerevisiae
tttgaagcct

SEQ ID NO: 12092 - DNA, 10 bp, Saccharomyces cerevisiae
tttgacaaca

SEQ ID NO: 12093 - DNA, 10 bp, Saccharomyces cerevisiae
tttgacaagt

SEQ ID NO: 12094 - DNA, 10 bp, Saccharomyces cerevisiae
tttgaccgca

SEQ ID NO: 12095 - DNA, 10 bp, Saccharomyces cerevisiae
tttgacggtg

SEQ ID NO: 12096 - DNA, 10 bp, Saccharomyces cerevisiae
tttgagaact

SEQ ID NO: 12097 - DNA, 10 bp, Saccharomyces cerevisiae
tttgagtcag

SEQ ID NO: 12098 - DNA, 10 bp, Saccharomyces cerevisiae
tttgatatta

SEQ ID NO: 12099 - DNA, 10 bp, Saccharomyces cerevisiae
tttgattact

SEQ ID NO: 12100 - DNA, 10 bp, Saccharomyces cerevisiae
tttgattatg

SEQ ID NO: 12101 - DNA, 10 bp, Saccharomyces cerevisiae
tttgcaacag

SEQ ID NO: 12102 - DNA, 10 bp, Saccharomyces cerevisiae
tttgcacctt

SEQ ID NO: 12103 - DNA, 10 bp, Saccharomyces cerevisiae
tttgcatatg

SEQ ID NO: 12104 - DNA, 10 bp, Saccharomyces cerevisiae
tttgccaagt

SEQ ID NO: 12105 - DNA, 10 bp, Saccharomyces cerevisiae
tttgccgtag

SEQ ID NO: 12106 - DNA, 10 bp, Saccharomyces cerevisiae
tttgcgaacc

SEQ ID NO: 12107 - DNA, 10 bp, Saccharomyces cerevisiae
tttgctacat

SEQ ID NO: 12108 - DNA, 10 bp, Saccharomyces cerevisiae
tttgcttcac

SEQ ID NO: 12109 - DNA, 10 bp, Saccharomyces cerevisiae
tttgcttcct

SEQ ID NO: 12110 - DNA, 10 bp, Saccharomyces cerevisiae
tttgctttaa

SEQ ID NO: 12111 - DNA, 10 bp, Saccharomyces cerevisiae
tttggaaaat

SEQ ID NO: 12112 - DNA, 10 bp, Saccharomyces cerevisiae
tttggagacg

SEQ ID NO: 12113 - DNA, 10 bp, Saccharomyces cerevisiae
tttggagaga

SEQ ID NO: 12114 - DNA, 10 bp, Saccharomyces cerevisiae
tttggagtga

SEQ ID NO: 12115 - DNA, 10 bp, Saccharomyces cerevisiae
tttggcacgt

SEQ ID NO: 12116 - DNA, 10 bp, Saccharomyces cerevisiae
tttggcagat

SEQ ID NO: 12117 - DNA, 10 bp, Saccharomyces cerevisiae
tttggcattt

SEQ ID NO: 12118 - DNA, 10 bp, Saccharomyces cerevisiae
tttggcgata

SEQ ID NO: 12119 - DNA, 10 bp, Saccharomyces cerevisiae
tttggtactt

SEQ ID NO: 12120 - DNA, 10 bp, Saccharomyces cerevisiae
tttggtagtg

SEQ ID NO: 12121 - DNA, 10 bp, Saccharomyces cerevisiae
tttggtgata

SEQ ID NO: 12122 - DNA, 10 bp, Saccharomyces cerevisiae
tttgtacaag

SEQ ID NO: 12123 - DNA, 10 bp, Saccharomyces cerevisiae
tttgtactgg

SEQ ID NO: 12124 - DNA, 10 bp, Saccharomyces cerevisiae
tttgtatttc

SEQ ID NO: 12125 - DNA, 10 bp, Saccharomyces cerevisiae
tttgtcgtaa

SEQ ID NO: 12126 - DNA, 10 bp, Saccharomyces cerevisiae
tttgtctgaa

SEQ ID NO: 12127 - DNA, 10 bp, Saccharomyces cerevisiae
tttgtgaacg

SEQ ID NO: 12128 - DNA, 10 bp, Saccharomyces cerevisiae
tttgttatat

SEQ ID NO: 12129 - DNA, 10 bp, Saccharomyces cerevisiae
tttgttcgtt

SEQ ID NO: 12130 - DNA, 10 bp, Saccharomyces cerevisiae
tttgttgctt

SEQ ID NO: 12131 - DNA, 10 bp, Saccharomyces cerevisiae
tttgtttagt

SEQ ID NO: 12132 - DNA, 10 bp, Saccharomyces cerevisiae
tttgtttccc

SEQ ID NO: 12133 - DNA, 10 bp, Saccharomyces cerevisiae
tttgtttgta

SEQ ID NO: 12134 - DNA, 10 bp, Saccharomyces cerevisiae
ttttaaaaaa

SEQ ID NO: 12135 - DNA, 10 bp, Saccharomyces cerevisiae
ttttaagtta

SEQ ID NO: 12136 - DNA, 10 bp, Saccharomyces cerevisiae
ttttaatgct

SEQ ID NO: 12137 - DNA, 10 bp, Saccharomyces cerevisiae
ttttacactc

SEQ ID NO: 12138 - DNA, 10 bp, Saccharomyces cerevisiae
ttttacagat

SEQ ID NO: 12139 - DNA, 10 bp, Saccharomyces cerevisiae
ttttaccgtt

SEQ ID NO: 12140 - DNA, 10 bp, Saccharomyces cerevisiae
ttttagatac

SEQ ID NO: 12141 - DNA, 10 bp, Saccharomyces cerevisiae
ttttagtagt

SEQ ID NO: 12142 - DNA, 10 bp, Saccharomyces cerevisiae
ttttagtcgc

SEQ ID NO: 12143 - DNA, 10 bp, Saccharomyces cerevisiae
ttttagtgac

SEQ ID NO: 12144 - DNA, 10 bp, Saccharomyces cerevisiae
ttttagtgtt

SEQ ID NO: 12145 - DNA, 10 bp, Saccharomyces cerevisiae
ttttatcatc

SEQ ID NO: 12146 - DNA, 10 bp, Saccharomyces cerevisiae
ttttatctaa

SEQ ID NO: 12147 - DNA, 10 bp, Saccharomyces cerevisiae
ttttattacc

SEQ ID NO: 12148 - DNA, 10 bp, Saccharomyces cerevisiae
ttttattact

SEQ ID NO: 12149 - DNA, 10 bp, Saccharomyces cerevisiae
ttttattatt

SEQ ID NO: 12150 - DNA, 10 bp, Saccharomyces cerevisiae
ttttattgat

SEQ ID NO: 12151 - DNA, 10 bp, Saccharomyces cerevisiae
ttttcaagtg

SEQ ID NO: 12152 - DNA, 10 bp, Saccharomyces cerevisiae
ttttcaatat

SEQ ID NO: 12153 - DNA, 10 bp, Saccharomyces cerevisiae
ttttcagagg

SEQ ID NO: 12154 - DNA, 10 bp, Saccharomyces cerevisiae
ttttcagcat

SEQ ID NO: 12155 - DNA, 10 bp, Saccharomyces cerevisiae
ttttccagaa

SEQ ID NO: 12156 - DNA, 10 bp, Saccharomyces cerevisiae
ttttccaggt

SEQ ID NO: 12157 - DNA, 10 bp, Saccharomyces cerevisiae
ttttccccct

SEQ ID NO: 12158 - DNA, 10 bp, Saccharomyces cerevisiae
ttttccgcta

SEQ ID NO: 12159 - DNA, 10 bp, Saccharomyces cerevisiae
ttttcgcaac

SEQ ID NO: 12160 - DNA, 10 bp, Saccharomyces cerevisiae
ttttctattg

SEQ ID NO: 12161 - DNA, 10 bp, Saccharomyces cerevisiae
ttttctcaaa

SEQ ID NO: 12162 - DNA, 10 bp, Saccharomyces cerevisiae
ttttctcgtt

SEQ ID NO: 12163 - DNA, 10 bp, Saccharomyces cerevisiae
ttttcttcca

SEQ ID NO: 12164 - DNA, 10 bp, Saccharomyces cerevisiae
ttttcttgag

SEQ ID NO: 12165 - DNA, 10 bp, Saccharomyces cerevisiae
ttttgaattc

SEQ ID NO: 12166 - DNA, 10 bp, Saccharomyces cerevisiae
ttttgagaat

SEQ ID NO: 12167 - DNA, 10 bp, Saccharomyces cerevisiae
ttttgagatt

SEQ ID NO: 12168 - DNA, 10 bp, Saccharomyces cerevisiae
ttttgaggaa

SEQ ID NO: 12169 - DNA, 10 bp, Saccharomyces cerevisiae
ttttgagtat

SEQ ID NO: 12170 - DNA, 10 bp, Saccharomyces cerevisiae
ttttgatatg

SEQ ID NO: 12171 - DNA, 10 bp, Saccharomyces cerevisiae
ttttgattcc

SEQ ID NO: 12172 - DNA, 10 bp, Saccharomyces cerevisiae
ttttgcgtgg

SEQ ID NO: 12173 - DNA, 10 bp, Saccharomyces cerevisiae
ttttgcgttt

SEQ ID NO: 12174 - DNA, 10 bp, Saccharomyces cerevisiae
ttttgctacg

SEQ ID NO: 12175 - DNA, 10 bp, Saccharomyces cerevisiae
ttttggaaaa

SEQ ID NO: 12176 - DNA, 10 bp, Saccharomyces cerevisiae
ttttgggctg

SEQ ID NO: 12177 - DNA, 10 bp, Saccharomyces cerevisiae
ttttggtaca

SEQ ID NO: 12178 - DNA, 10 bp, Saccharomyces cerevisiae
ttttgtacag

SEQ ID NO: 12179 - DNA, 10 bp, Saccharomyces cerevisiae
ttttgtacga

SEQ ID NO: 12180 - DNA, 10 bp, Saccharomyces cerevisiae
ttttgtgttc

SEQ ID NO: 12181 - DNA, 10 bp, Saccharomyces cerevisiae
ttttgttcaa

SEQ ID NO: 12182 - DNA, 10 bp, Saccharomyces cerevisiae
ttttgttgtg

SEQ ID NO: 12183 - DNA, 10 bp, Saccharomyces cerevisiae
ttttgtttgc

SEQ ID NO: 12184 - DNA, 10 bp, Saccharomyces cerevisiae
tttttacgtc

SEQ ID NO: 12185 - DNA, 10 bp, Saccharomyces cerevisiae
tttttagagg

SEQ ID NO: 12186 - DNA, 10 bp, Saccharomyces cerevisiae
tttttaggca

SEQ ID NO: 12187 - DNA, 10 bp, Saccharomyces cerevisiae
tttttagtgc

SEQ ID NO: 12188 - DNA, 10 bp, Saccharomyces cerevisiae
tttttcagtc

SEQ ID NO: 12189 - DNA, 10 bp, Saccharomyces cerevisiae
tttttcatat

SEQ ID NO: 12190 - DNA, 10 bp, Saccharomyces cerevisiae
tttttccgca

SEQ ID NO: 12191 - DNA, 10 bp, Saccharomyces cerevisiae
tttttcgtat

SEQ ID NO: 12192 - DNA, 10 bp, Saccharomyces cerevisiae
tttttctcag

SEQ ID NO: 12193 - DNA, 10 bp, Saccharomyces cerevisiae
tttttctctt

SEQ ID NO: 12194 - DNA, 10 bp, Saccharomyces cerevisiae
tttttggtgt

SEQ ID NO: 12195 - DNA, 10 bp, Saccharomyces cerevisiae
tttttgtata

SEQ ID NO: 12196 - DNA, 10 bp, Saccharomyces cerevisiae
ttttttaact

SEQ ID NO: 12197 - DNA, 10 bp, Saccharomyces cerevisiae
ttttttagag

SEQ ID NO: 12198 - DNA, 10 bp, Saccharomyces cerevisiae
ttttttgaat

SEQ ID NO: 12199 - DNA, 10 bp, Saccharomyces cerevisiae
tttttttaac

SEQ ID NO: 12200 - DNA, 10 bp, Saccharomyces cerevisiae
tttttttctg

SEQ ID NO: 12201 - DNA, 10 bp, Saccharomyces cerevisiae
ttttttttaa

SEQ ID NO: 12202 - DNA, 10 bp, Saccharomyces cerevisiae
ttttttttta

SEQ ID NO: 12203 - DNA, 10 bp, Saccharomyces cerevisiae
tttttttttt

SEQ ID NO: 12204 - DNA, 230196 bp, Saccharomyces cerevisiae
ccacaccacacccacacacccacacaccacaccacacaccacaccacacccacacacacacatcctaacactaccctaacacagccctaatctaaccctggccaacctgtctctcaacttaccctccattaccctgcctccactcgttaccctgtcccattcaaccataccactccgaaccaccatccatccctctacttactaccactcacccaccgttaccctccaattacccatatccaacccactgccacttaccctaccattaccctaccatccaccatgacctactcaccatactgttcttctacccaccatattgaaacgctaacaaatgatcgtaaataacacacacgtgcttaccctaccactttataccaccaccacatgccatactcaccctcacttgtatactgattttacgtacgcacacggatgctacagtatataccatctcaaacttaccctactctcagattccacttcactccatggcccatctctcactgaatcagtaccaaatgcactcacatcattatgcacggcacttgcctcagcggtctataccctgtgccatttacccataacgcccatcattatccacattttgatatctatatctcattcggcggtcccaaatattgtataactgcccttaatacatacgttataccacttttgcaccatatacttaccactccatttatatacacttatgtcaatattacagaaaaatccccacaaaaatcacctaaacataaaaatattctacttttcaacaataatacataaacatattggcttgtggtagcaacactatcatggtatcactaacgtaaaagttcctcaatattgcaatttgcttgaacggatgctatttcagaatatttcgtacttacacaggccatacattagaataatatgtcacatcactgtcgtaacactctttattcaccgagcaataatacggtagtggctcaaactcatgcgggtgctatgatacaattatatcttatttccattcccatatgctaaccgcaatatcctaaaagcataactgatgcatctttaatcttgtatgtgacactactcatacgaagggactatatctagtcaagacgatactgtgataggtacgttatttaataggatctataacgaaatgtcaaataattttacggtaatataacttatcagcggcgtatactaaaacggacgttacgatattgtctcacttcatcttaccaccctctatcttattgctgatagaacactaacccctcagctttatttctagttacagttacacaaaaaactatgccaacccagaaatcttgatattttacgtgtcaaaaaatgagggtctctaaatgagagtttggtaccatgacttgtaactcgcactgccctgatctgcaatcttgttcttagaagtgacgcatattctatacggcccgacgcgacgcgccaaaaaatgaaaaacgaagcagcgactcatttttatttaaggacaaaggttgcgaagccgcacatttccaatttcattgttgtttattggacatacactgttagctttattaccgtccacgttttttctacaatagtgtagaagtttctttcttatgttcatcgtattcataaaatgcttcacgaacaccgtcattgatcaaataggtctataatattaatatacatttatataatctacggtatttatatcatcaaaaaaaagtagtttttttattttattttgttcgttaattttcaatttctatggaaacccgttcgtaaaattggcgtttgtctctagtttgcgatagtgtagataccgtccttggatagagcactggagatggctggctttaatctgctggagtaccatggaacaccggtgatcattctggtcacttggtctggagcaataccggtcaacatggtggtgaagtcaccgtagttgaaaacggcttcagcaacttcgactgggtaggtttcagttgggtgggcggcttggaacatgtagtattgggctaagtgagctctgatatcagagacgtagacacccaattccaccaagttgactctttcgtcagattgagctagagtggtggttgcagaagcagtagcagcgatggcagcgacaccagcggcgattgaagttaatttgaccattgtatttgttttgtttgttagtgctgatataagcttaacaggaaaggaaagaataaagacatattctcaaaggcatatagttgaagcagctctatttatacccattccctcatgggttgttgctatttaaacgatcgctgactggcaccagttcctcatcaaatattctctatatctcatctttcacacaatctcattatctctatggagatgctcttgtttctgaacgaatcataaatctttcataggtttcgtatgtggagtactgttttatggcgcttatgtgtattcgtatgcgcagaatgtgggaatgccaattataggggtgccgaggtgccttataaaacccttttctgtgcctgtgacatttcctttttcggtcaaaaagaatatccgaattttagatttggaccctcgtacagaagcttattgtctaagcctgaattcagtctgctttaaacggcttccgcggaggaaatatttccatctcttgaattcgtacaacattaaacgtgtgttgggagtcgtatactgttagggtctgtaaacttgtgaactctcggcaaatgccttggtgcaattacgtaattttagccgctgagaagcggatggtaatgagacaagttgatatcaaacagatacatatttaaaagagggtaccgctaatttagcagggcagtattattgtagtttgatatgtacggctaactgaacctaagtagggatatgagagtaagaacgttcggctactcttctttctaagtgggatttttcttaatccttggattcttaaaaggttattaaagttccgcacaaagaacgcttggaaatcgcattcatcaaagaacaactcttcgttttccaaacaatcttcccgaaaaagtagccgttcatttcccttccgatttcattcctagactgccaaatttttcttgctcatttataatgattgataagaattgtatttgtgtcccattctcgtagataaaattcttggatgttaaaaaattattattttcttcataaagaagctttcaagatataagatacgaaataggggttgataattgcatgacagtagctttagatcaaaaaggaaagcatggagggaaacagtaaacagtgaaaattctcttgagaaccaaagtaaaccttcattgaagagcttccttaaaaaatttagaatctcccatgtcaacgggtttccatacctccccagcatcatacatcttttttcaaagaaacttcaaatgcctcttttatgcaaggggcaaaatcctgaaatgacttaaacttagcagtttcgtcttttttcaaagagaatggttgaagaagaattgttttggacgcttattgacaatctgttgcattgataaagtacctactatcccagactatatttgtatacaagtacaaaattaggtttgttgaaacaactttccgatcattggtgcccgtatctgatgtttttttagtaatttctttgtaaatacagggagttgtttcgaaagcttatgagaaaaatacatgaatgacaggtaaaaatattggctcgaaaaagaggacaaaaagagaaatcataaatgagtaaacccacttgctggacattatccagtaaaggcttggtagtaaccataatattacccaggtacgaaacgctaagaaccttgaaagactcataaaacttccaggttaagctatttttgaaaatattctgaggtaaaagccattaaggtccagataaccaagggacaataaacctatgcttttcttgtcttcaatttcagtatctttccattttgataatgagcatgtgatccggaaagctactttatgatgtttcaaggcctgaagtttgaatatttatgtagttcaacatcaaatgtgtctattttgtgatgaggcaaccgtcgacaaccttattatcgaaaaagaacaacaagttcacatgcttgttactctctataactagagagtactttttttggaagcaagtaagaataagtcaatttctacttacctcattagggaaaaatttaatagcagttgttataacgacaaatacaggccctaaaaaattcactgtattcaatggtctacgaatcgtcaatcgcttgcggttatggcacgaagaacaatgcaatagctcttacaagccactacatgacaagcaactcataatttaagtggatagcttgtgataaattgaattttctctgtttagtacttgccgaatagttacttgttagttgcagatgctttttgatgacaaagttatcaatctcaatattaaactttttaggctttcaggtttaatctttctttgagggtgtattaattttcatacaaatatttgattcattattcgttttactgttacattagacctgctcattacatggagtaacttaagttttctcaaacgcttgatagcatgatttgatgtagtaaaaaaaaaggcagagtttccaaaaaaaattgttaatcgacaaagttaatattatggtggtagtatctcaaatatctggataaccagatcgtacatctctgataaacaatctttgccactgctttatccttttaaattgtattgagtgcttcagtcattgcaaaattttacgagatttaaaatttgtgaacccgaccttaccgagaaatgatgagctaatttttataggtcgacccttctgtcgcttactgggttgattatcttgtgctttcttagtatctatcacaaaggagacaaaatcgttgataaaaagtgcatcaacattcccagccagaaaatgcacatcataaagacatgttattcaagagccacgaccgtcttcaatttatcttttataaaaaacccttgttctactgacaggatggaatagatattaaatatacattttgcatttttttttttttctgtattgaagatttgtatatgaaagatgtttatacatcaaatgctttgaataaagccatcttaatttcaatttcatgccctccttcaccgttttctgttggtctagaggtagcttgttgtggtcactaatgagaacttaaatagttttcaactgctggtggtaaatcaataatttatgttcttaacctaacatttgatgacctttgatgcgttggttatgttgaagacaaattgcctctaatcagttccattaagaaatcttcttaactcctccaaatattctgcccatacgatacctatttgtttactttgtcattttgccataagattggtatccacttcttgtctgtaaaataattagaaagtagcacaatttttacagtaatgtagcacgcgtaactcctaaactttgtcataatggttgaaatgaatgtatgatataaaaactcggaccctgttttacttcttttatagaaccttatttttgacgcagggaggcgacatttatccaaattaagttttgacatggcgcatcagggaataaaaaaaactttattatgtggccgaatcaacattaatcaaatgcactaatattgtaacgttcttacaaagggcagacaacttgagaactttcatgcgtgcaacagtattaatattttactgtcttgatatcgttatcctcatcgtaacgtgaatttttttgtctcatacgttaaggtaaattttgatgacccccgttgtccttgtttgccttactgtataaagcacccttttattgtttagaatactagaatgataactgcattcggactatgaaagaaaaaatggtagtagcaaaggatagcatcgccgtatttactactttgtaaaccagtggatttttgctcaacatataaaaaactaaagacctttttttcatcaatatacttctgagacgtgcagatgtgatattcgggtttgagcttgtagtcaacgaagcgggttcatgggcaaattttcttttttttccctttttttttgtctagattatttcgaatatgagttaatcatacgttgattagtactgttggtctctcattgaaattttacgtgacaccatcattttacttccacataagttctaatgttacgtagttcaattttagtcgacctagcttcatatttattttagaagcaattcgtaattatcattttgctttcgaagaaaattaagacttcatttactattctcgtgatattttagtaggcgcttcttttgtatcgaaccattttattgcaatggcccttaagttaccgttattcataccaatttgacgttaattttaaatgcgttctgaagtttcttaaataacccggattggttaggttcacgccatgcctggcgcgtacattgaggcattagaagatccgcagataaataataagcttagtaaatcctaaagataacaactaaaattatatttccatcagctcaataccgcagtactttgaaacctgatttatatattgcagaacttaattaaaagtacattgtagttcaaaaaataaatatcaaacttttggaccctctcttattgcctcccaattaattaaaacatcttttcttccaatctacaggtttgaaaaggtaataagtaatataaacttgagaaccaaaaaaaaaaaaaaaaaaatactgatccttacaggttttaaggttgcaaagggaacatttattgaaaggagctaacaatagtgggtatgagtaaagatatatagatcgatattttgaattctaaatgatgaactagggaagtaatttaggtgaaacattgcaaccaatcattttacacttttggttgcacgtaatgtacctttttatgatattttttttttatagtagtagtgtgaaaatttcttcaggacttgcaaaaagaatctaactgatcttcggatgagcctttatcgattatttttttcctaaatataatactttacaagcgaatgttttgttaggagaaagatataaaaattatgcggcataggcatattatccaataaaaaggaaatttatatataaacttcatttacgtcataagaaaatgttaagttctcttaacgaaaactgtgcgaattttgtgttaaagctggatgatgagaaattattctcgtattatttttcatcagatactgataaggtttcaacgtcttttgacgttggcttttccacaccatgtttagagttataaagcacaataccgttcttcttggcattgttcctttcatcacgtttatagaagtagagtacaacaaaagtccaaatggagagacaaaaagcagaacatgcagtgaaagtaaacccctttaaatacctgggagcttcttctgttttccaaaccaaaacacttatccatgcggtagatgattgagccataatattcattgtaactaaagtaatagctctagtttgagcatctcggcgacaaatatcgttttgccaagagtataaaacaggagccatagcccaaccaaaacattgcagcataaatgcaaaccatttggctccttctgcgacgtcccaagcggctaatatggagttaccaatgatattgaaaacctgagtaaaaataatcgcaaaccaacgagagtgtaatttatctgcaataataccagtaagcatcaaataaaccatacctaaacccggagtaatcatggataactgattgagcttaggaatagagtatcttttcaaagatttcaaccatagtaggtatgccccagatgaaacattactgtcattccaacagaaaatattccataaagttaaaatgtatattttccaatcactgaaaattgttttccacagtttaatatcgaatacttttgtttcaaaatcacttttacctgtttggttttcttttaatcttttcctcgccaacctaatttcatcatcagttaagaaaatagaataacagttgtatgggtcacctggcagggagtaaaatccaataaggcccactacgacagacacaatagcgtcaataataaagttccatctccatccctctaaaccatttacaccatttaacgatgaatatacggctgactggatcccaccagcggatagaataccgatatactggcccaaatagtaaaaagcagaacgacgcaccatttcatcatgtttgtaaaaggaaccaaacaaatattggtatgccaaataacttggcgcttcaaaagccccaatgaaaaacctaattgctttcaagtgtggtacagaattgacatatgcagcaccaacggttaaaagcgaccaacataagtcgaggcttggtaaaacatagtttaatgggagcttgttcaggtaaatcaaaaatggcaattgaaatataatattaccaactgtgtacattacttgagtatgcaccaaatcattaccttgaaagcctaaatcttccttcattcccgaaacgtaagcgttgtttatattaaccgtatccagatatttcacccaataagcaatacaagaataaaaggctaaaaggacatccaatttaattaataattttttttctttgaaagaggtaccctgtttgaaccaactataccatttattgtgagatctttccttttcattgatccgatactcttgttcatcgaaaaatctccaccatggcctatcggcttcatctctatattcataacttctagtaacgttcacattgtctttatgttcactatagctactagtctcaaaatgtagttgatctttttcacttgtagtcgtgatgaaattttcagctgtttcatgactctggatactgttggagatagtgacaatttctgttgaatttaagtcatctggcaggtcttccacctgccgctttactggaataaaaccccattttagtcttttgtaaggatctacaataatctctttaacaattgaatacatgtatgttatttatatatgcagtagttctctttgtaattttttttaacaaatagagagtaagatatgtagcgaatgtccattcatcataacaggtaaactagatgctcttttatatagtctggttgtataaataatttatatcctcatctaaacgcatgtctccgcttggtttcttatctatttgtggaggcacccgtagtactgtgctttcgtatttttttatttatttattatttgtagcagtttttttccagtgacacaatctttaccattacacagtttttactatttctaatgattacattggaccatcggaaaactgcgctaactttggataacgccacagaacgtgatctgactattgtaaaggtgtcattcggtaaggtaaaccttcaaggcgtccacacctttaaccatataacagcgtaaactcttgttaaaatacaggggtaagacattggtggatattcaacaagatccgatacctccaattccgatttctacaaattgtgctctacatattactgcgatgcaattatccacacataaaatcgatgcctttagaaaaagacataaagcagacggcattgtagatatttgaccaattagaattgaatgagatgaatatctcaccaagctattcgatattatagataaagtttgtatcttagttatgcattgtgagttggttgctctactcgcggttaccagtctcttctaaaaaatctaaggccaatggtatccatgacatttctgcactttttgtaattggtttagttatgaaaggaacgtcaaaccaaatggtttttcagataagaaattgacagtatctgagaatttgctatcaaagctcagaggatttacatattttaacgtaattaaaacatttttatgttcgatatattagcaaatagcgtattaatatacagctgttgcgctcatggtaaaatttagcgatatactttgcatcttggctgcaaagaagaatgaatcggatatactatttttgatcataatgacggacatcatgatataataacgttatacggataactttatttcaaaagcaccatcatgttatctcttgtaaaaagaagtattcttcattcaataccaattactcgtcacattcttccaatccaattaatattggttaaaatgaaccatgtgcaaatcagaaacataaaattatatcactttatttcatatggtttcatgcttacaaagcttactgtctttctctttaacttatttttctacaggctacgaattctttgcaggcttactttactcatattatcattacctgtacaaatatatattaaagaaatccaaacaaaaatgcttgaaaagcatacagcttccgatacatcatgtatatagaaaatcacagtacaaaaattttgaatttatgtataaccgtttcgcctgatatatgtaagagctcttgattgtcggaatagttcgggaattctgggtggaactagtagctggagatgcgttctaaaggatctaaaatcagactcaccccaaaaaccaaaattttgatattcaactttagtattagccagtcttaaaatgattttttgccaagaaagccgaagtttaacgagcgttttaaaatatgcacaagtccattaattaaatttgatcacagtgattaccaattttgttgaaagcagtaatttgtgacgtccgtttttggcacaagtaaaaaatatttgttttgaagtctagttacaagaagctactgaaaacacagggctggatatagatgtttataagctcctcccatggtctaagagtttctccaaacgcctaatgtatgcaatttgttaaataaaaatgaagaatagatgcataaacaagcgtcattaaagttcttatcattattccatgtagaaatgacctgcaagtacgagctggttatgcgaaactgagcttaacaacatagttttcttttccattggcttggatataaatttttcgctgagaaacttctctgcattttttaagcattaagcgtacataacataaagtcactgagatattagaggttataaaaaaagactacgtgggtgtttacctaagattttcacaacttgtttattaattggataaatagtatttttcttggcatttacaaactttatgtttttaggtgtatttgcagttccattaagggaaataagtcataagcttttttggaaaacagattttttgccccgcttaacctgaaattgatattaaaagaatgtgtgaatggccattaactaacaagagaattaataatgttaaaacacagatacctcgaaacaaactctatgtaaacacttattttattgtggtaatattttttgataacaacacatctgaaacaaaataatgcaaagccgaatagttaggctaaaaatgtactcttagacatttaaaaaggtttatgaatcctatggtatttaatatattaaagaacgaagtaaatgggaaaaaatgtgtaaacactataagcgtgatgatagaattattaatataagatgatgccgtgcgtttaccatacgattgccagcaatacggtggaaataaaaacacttatgccattattggtcaacagaccattggcaataccaacgtaggttgagatttctaaagaggcagtactagatcctattatgctacttgctggtgtgctacgaggctgttgcgacatagtacttaacccggaagttattagactcttggtgttgccagtttcggatacagaaacaacactactgctgtgaccaatcacatcggtcgcggaagccgtctgtgtttcagcatgattgaatcttgaaattgaagaggtgactactgttttcgtctcagcagctccagtactggtagttgtctcagcagctccagtattggttgttgtctcactggtagcactgttcattttagagctgacagactcttcattcgtagtctgtggcctccatgttggatagaccgtaacaacatcattcacagtagccgtggccgtcgaaacaatggcaggtgaagcagtttcggaacacacaccagattcgcaggaagtaacagtaactagcgtagtttgttgcctcgattctgtggtggaaataggacaccatgtcgtgtattctgtggtaacgccgttaatagtagcagtgcttatagatacaatggctggagaagcagtcttagagcatacgtcagattcacaagaagaaattgtaactactgtggtttgctctgttgtccccttggtttgctttgttgtctccgtagtttgctttgttatctctgtggtagaaatagggcaccatgtggtatactctgttgtggcaccgctaacagtaacggtggccgtggaaacaattgcagaggagatggattcagtgcacacatgagattcgcaggatgtcacggtaaccaaagtggtttgttcgctcgtttttgtagtggtagcaggtggtaatgaagaagcagtttcctggcttgttgttgtactgataacaggtggtaatgatgaagtaatttcctgacttgctgtcgcactggtaacaggtggtaatgaagaagtaatttcctgacttgttgttgtactggtaacaggtggtaatgatgaagtaatttcctgacttgttgttgtactggtaacaggtggtaatgaagaagtaatttcctgacttgttgttgcactggtaacaggtggtaatgatgaagtaatttcctgacttgttgttgtactggtaacaggtggtaatgatgaagcagtttcctggcttgttgttgcagtggtaataggtggtaatgatgaagacgaatatgtagactttggtgattcagaagagatagaagaggaagaagagacagaactagctgaactagtttcgctctcagaagaaccagaggtggaactactggttggaatgacggatgatttaaatgattcagagaatatagaagtggaggttgttgtagaagaaatgacaggggaagaaatgaatgaagaagaaatgactggagaagaagtgactagagaagaagtgactgaggaagaaatgactagagaagaagtgtctgaggaagaaattactgaggaggaaatcacagaagttccattgctaggatagaatggggtaataattggatgctaagacgtgatagagctggttatttgttctgaagaagatgatgacaaactggatgaggtggcagtggttggacttttagcaacaataacggtttcgtcagttggttgaccattagtgccagtgacagtagtcatctcagtagaagtcgaagtggtagttgcgatggtgctagtagtatgttttgaaggatcagggatagtacaattgggctgttaggtcatcgtcaaaagagtaaacgtgccctgcaaaatcatcgctaacagtagtaacatcaggcaattccacgctaactggcagtgtatgccaagaaacagcgtttgagtagacaatcttcattggacagtagaatccagcatacatatacacagtccctgcaatgttatcgggcaatcttccttgccatggcttgataccattaatcgtaaagtttgtggatgtaattggaggttgctcttgtgcacagcatccgaatgcaacgtcgccaccgactgatagaattgcagagtcatcgaccttagcaaacctgaacgtgtaagaacttgtttgtggtggtaaaaagtaacctgtcatttctagagtagcgttttttgggatagtatagaaaccaagtaaatcagtactccaataggtctttcctggctattttgaacattcactatgacctctgcatccccagtttccataagcatctgattgagcacatttaaaagttcctgaagagataacacaagaaagatcgtagtcaattgagaaatccgtctgtccgccaacggaacctaattccaattcgaggcatatccagaagtcatatattgcgggtaggaatacgttgttgaattcagtaatgagtacaaaagttgacattcatcccatttttcctcgggtccgttggcaagcatgcttgtgtacttcctgaaacaacattggacgtggccaggtaggtgaagagtgccaaaaataaatagtgatgaggcatttcttggttcgtcaatcaggtatgggtatattaaacaataactttaagccatgctgttaatgatgaaaattctgatgctggtctcttcatatgtcattgttttgggaactgtcttttttcgatcagatgtatgcgcaacgatttgtttagcgtagtgatgttcccgcgtagtacttaggaaattttggtatcgaaacgtccctacaacactttttgtcgctgatatctgcacatgtgagtaacgcagattccattgcattattaccttccccttcccagaaacgatttattacgactcaacaagttcaagaaaaaaattaaaaaggttacaaccgcattttgcgtttaggtgcagcgagacttaccttgatgcagtcctaaagggtcctgcagcggttgtaacgaatcctatttgcttttgtgcattcctaaacgggctgaagtaaaagtcttgaggaactccaggagaagatacgataagctccgaagtgccaaattttattatcaaaaaaaaatatttgtacgagcggaaaaggattatactcttcctcttttgcttcatcacaagaggattattttgacgtcgtctgttgtactacttctttatcggtgtgcgcaggaaaagaaagaaaaaggaaggaaaaatagatgtcaaaaatcgatgtcaaaaaatctcgtgagacctccggaattttgacgctgcaagtcaatctacgggaaagaagaaattttttaaacctaatgcaaaataagcttttcttggaaaataagattttcggcaataaaaggtaaatgcagccaaaaatcaaaatacttcagaagaagtcgtagcgaggactgctaaggggaagcggatttgaagatcctttccagaacaagaaggagccgaaagctgtcaggaactgttcctgattttttaggaaaacaattaataggtatctcgtctagagtagtatctcgagcttccagaagttgcagataatcaaaatcattgttttatccctttttttagattacagcttagaagagtagagagcaagtttactgaaacggttccttgtttacaataatattcctaacaaactttacgaattaggatgcagcatgattttttatattgcttcacttcctaaagtatgaatttttatccgtagtcgcaaacaaaacagctactggaaatctgcagcttgttaaaaaccggtagtttccgaatactcctcgtccttgagttgtataccgttaaacttcctagggtgtcatgtgtctggcccaattggcccacaaaatctggtcctattgacggttttcttttgattttcagcatcttcctctaagaaggacagaaaattatgtaatatatgggagaaacggcctcccaactgctaagtgtccccggcagcacgagtaagcaaaattcaggcaaactattgcattaagaagccgtacataattcagcgtgatatgatgaaattttgttaattgcaaattttagtacgatttggttgttagtgtgtgtttatgcaagtaattattgaaccctaagtagttactgtcttcttttgctgtaattcgtggattcacggccctccagcaacatggattgaaaggttctttaaagttttcaatccgtaaagttctgaaatgtattttaatcatgtcaataattttactggtgagtagcatttatgaccaaaagcgtacttaaattagcagcaaaaaaatttttaataacgaaactataaggaaaatacgaggtactgattatgagagtccccgtttctcatttttgagacatgatctgaacaaggctgaaaacagcaatctttttcgataacttttgcaaaaatttcaaacattgttgtttgaatgcagccaatttttatagggtacagagcttaatgctttacatgtgctttattttcggtactttccttaaagtgtctacattatctctcaggacttgaatgtcttcggctgaattactataaaatcttgagttttctctgaagtttaatcctaagacaatagtggtgagtgatgtagttcacgtgtgtgccactggtaataatagagataactatctcagttaagtttgaaaaggtaaaaaatagtttaagtagtcattttttgcgacggtcattcttctctgatgcacgttctttagactacctataaacaccattcttacggaattataatggaaataaaacatcagtacgtgttgctgtcggtgatagaggggtaacagaaccttaattgaaaaattagcacagtgcataatttattaacatgattgttttctgtgggaaataagaaatttcagcaccagtaaaagacgagaaatatagggcacataaatgcgctcttactcgtatgttccaggatgaaaatgtttagggcatcaagtattgccgaaagggcaatatgctttaacaccagaaaatccactgtatactcgttacgggtaaacaaagcaaaacgcagtgcgtgataatgtttctaaaatctctgcacactgttgaaatgcggctctgatactttagcccttagtacctgacggtgcctaaaatgaggataagtatatgagtttacaacgaatataatgctttttacctcatcatataaagaataatattaatttaaaagtaaaaattagacctaggtggtaatgaggaatgtgtcctaatgaatttatgtagttgatgcttttgcagcgtttttttttttttgtattaatcaaagtgcactacgtgacaaaaataaaaagtggatgaaaacaaaaaaatcacagattttcataaaaataacatggtattcttaatcgtatatcgtaatggattgtcaaaaataaagagaatatagtcggttcaaaccactttgtacgtctacagagtatagtgtagaaattatagttaggattgtgacatccctttttctttaacataataagtttgcttcaaattaattgatcaattaggataataactctcaacacctttattatttatgtttagagagtttatggtcagatggtgattggtattgatacttatactttttttctcattagtataatacgctatattccatgtttgaatagatcttattttttggctgtctagataataaacataccgtttttaacacacacacaccaatgagtagacgttattgcgactgtatgccctttaagatattctgttcaaagagataaggtatttattcgttttcttgcaatttcttctcatctatcattatcataccagattgaatcttattttttaatttttagtctatttgatgacggctactgaatctttacattacttgagctgagaagtaaaattgcattattcatattaaacaaaaaaatcaatttcccataaagacaatagctcaacttcatcacgtccttggtttttaccgagtacatatatttgatgaattctgatttgaaaatatcaatttgttcctctagaatatttccactcgcacattcaaaagcaggtattggaacgcacaagaagcgatcgtcaccttccattggggttagtagcaggatatatatttccattctatattccaggttctctttcacaattttattgaatgaaatacctgagctaccaaatcagtcttaataacaccatcttttacaccggtactacaacaaaccatactgagtctgaaattggacttctgcaatgaaaaatttaagccctgatctacgcataatgcccgctataaaccttattttttatatgggggtctggcgcttcgggaaaagagaggaaaacttgtaactcaatatatctcgatacaacattacgttttgtaaatttatcacaaaagccaaatgatgatatctctcttgcaagttatcgaacattgattggtaatttgtttgaaaattgttaatttattgaatatttcttttgcaaaagaaatagtctcagcgaaagctggttacaaaatttacatcatgagtttacgggatttgtaaatacgctttttgcataaaaatactttgccgtttcccacccttgcatattcacttactccccccttcatatactctatgtaatgatgattaagctttggccgctaagtctctcaattagtgttgattttggttttattcatatgattcttctttagtgaagtattgatcaattacgtgagtcagctttttgaaaaccccatttggaaggaattaggaaattattttgcttactacgaccactaatttaccgccatttctgggcctttttattgactattttgaccatgtgctcgactagaagaacggcatcataatctgctggtagagttagtctataatgattgttgaaaataaaggcataagagatattccacctaaaattcaagttattgactttattatcaggatcttagtatccttttttggtaagtcatattcaatgaactaggtctcgcaaactttttgttcgaaaagcggtagtgcatagttatgctaactctggatatatggcataaaccgtacaacactagcccatttttttggaagtagtgagggcagctagactgtatgatgaatattcgcctgcatactgagttttttggtccttttttttatgtggctggccttacgatatgatgcacaattcataatttggaagaagggcagaacaattgcatctgtgcttggctctcaagaacggtgtttggtgcatcaaaagttttcgactgcttatttggtcggaaatataaaaactcgatcctcttatctaagcagtatacattcttctttttgaaatgaatgtactccgtaatatcttcttatttggcattttcatccttaacttttgcatggctctgaactagtcagatagttgcccttttcagcaaacctcttattattgaaagcatggtgtacatccgttatactattatattataagaaattgggatgccaatttttttgcttttgttttgcctgttttccttcttttcgcaaaagtaattgcagatttaatagcaggatattataccgttggtaaaacttaaggattttatgaacaatagcttcaagtacagcattcatagaaccaactactaaggatgaaactagtatgtttttgtcaaaatattttcttgaccttgctgtaacatcaagatctgtttctctaagatattaaagttgagtaaaaacaaagctgatatgagaaaaatacgtaattgctccacataatacgtgggtcagacataaaggtagaatacttgatacagaagagattattcggtactcttgatggcgtgcttgaactggtgcctcttaacaaccggtaatatagtcagatgagtcactacgagtgtgtgtagtagcaagtgttttacctacgtggcagtaagagtagctctatggttgtgtaatagtggtgcttattcctaatgctctgaagtctgaagcggtacagttggtctggtctatatcatggtcaaaggagcaaacatatcttctgaagtgaccgcaaatagtactatgatgtggttggcaatataacttaaaaggaaataaccacaaggaattgcacccatgtacacagtttttcccggaaattgggaaaccagtacgaacatatatcaattacttttacattatcttgattggaaaactggcacaattgactgtgacgttagtagtatgttgttcttctctacatcagttaaatatacgtgtcaacatcaactaatcaactttcccccgtttaccacattgaagctgggtgtggaagatttatttgaagaaactaaaacgtaccctgtcatttcctgagtcccctttcaacttagtgtgaaagccgaacaattataatcctcggtagacaacagatttattgtactaaagttactcttcctgttatcttccttgattttactgttatagcaatgacccaccgcaatcaggagagccgccgtatggaatagcataccaagtcataaaatcgtcaacctattaacggggttcaggttctttttcagcgtagtagccctttaacaagcgctgacaaagttgacactcagagaaaattcaggatttattgtaatccagctactcatccttagatccgcttgcaggcatggtttttttcaccttgagaggctattttgggtaagccaggaaggctgaaaaatcccaaaaggacacagtaataagaaattgttgttgttgtatgatgcatttagaactcaaaagacgagtttctgaaaatgcttacaatactccataggtaacatgatttttttattaaaaaagtatactgttcctttgggtaaaaattatgcaacccttgagtgtccgatgaagataagactacgaaacaatttgcggtaaattttttctgctattgacatttacacatgctccaatccattaccctttccattctcgtaataaaacctcgaactgttatttcatatttacatctagacgggtatcggcctcaacaactccaaacaaaagtaaatagaaaagagccagacctatcgcaccgggtagagccagaaaatattttaaactatagttgacgtattctacggctgttgtttaggacaatactttttccttcacaggcttcgaattacgcacatgcagaactcctgtagaaaccacgaagaaaagtttaattaactttcaaatgccagaactaaagattgatgaaacagttatacgaatttaaggggaacttgctttttccttttgcttcatcataagcgcaatattcgcagcggtggcgtcgcgtcttaccatttatcggcacatttttccgaaaaggaaggaaaatggcggtgtcaaacggtctggtgtgacatctagaagttcggcattgcaagttaatctacgggaaaaagaaaattttcttataaccctaatgtataataaggttttcggagaaagcaactcacggggaacaattggttagaagagaccgtagaagcgccccactaacctggagttgattatcgaggatctttctcagaaaagcagctaataaatgagcacagtactcaaaaattactcatagtattataattacttacttagtcaatatggctgcgcttttaaaatgagtatcttttattttttgacaaggaagaaaaagatgcaagcaaagagaaatttactaagtacaagctcatttccaaaaattcagtttgcctgtaacaatgggtagcgatcttcaacatatgggattatgccttgaatgagatttttgaacgtagaggaaaaaatcgcagacaggctttattgtgctgtttgacatagtatactcagccgttgtggtgttaatgaatactatcgatgtgtatacaaacgtacttcaaataagcaatgcgatatactgcaacttttcggcctttgcaacgatttgtaatgaatccttttgcatcgctagaaggacaagataatatttcttctgttttttttttacatatgcaacaatttgaaagtcaggtcaaagacagattccggttccccatattcagattggagagaaaaacttttggcaactcatgttaccaagtcgagacgcttaaagttaagtgtcggccaagacacgcaaaatcttgtaatcttttaacgctgctcttcaaatcacggacgcaatcagtacttgtacctaattttggttttctaatattgaatagcgaaccataggtcgaaaatttaaggccacataaatccagagcccgcaacttggataggtatttacttgatttttagtttgctttcaatagtgtcgtgaaattataaagtacgccgcatatatatcttgattagttaaaaatagcagtgttcaatgatgatttgatagggttcataactggtaccagcgtagtacaattacgattatccatgaacataaaagtggtttaagtactatatatcagtgaagcttcaaagtaagcaaacgagataccaagatcttgtaggaccacgatatataagaagcctagttccgttgtagcatcacatagaagagagcgacaatgcctcagaaattctacagcaacagaaagcacagtgagtcattaactgttggaataagactcaactgcgagctatcgactagtacttatattactagtatattatatacggtgtgaaaagacgacatgaagattgaggaaatggtcccaagatctaatggacactgaaatgcaaaagttgataatgtaacatgaaaattaaggacagcatattaaacagaagaggaaataatggtatttttacatagagatatgaatttccctttttctttgttcctatatctctgataataagttataatatactttgtgcatcttatatcatgccttttcaacaatgaaatatcagcagttatcaaagcattcgccaaatttttattaataaaacaaatgtcagaaatatggccggaatctaatctgaaagttaaaataattcttacgatattcttatcataaaaccaatgattaatgtttatgatgagcaaaactgtgcgagggcacatacatacagtgggacctcatgagatccagaaaaaaagcaaaggaaagttcgatcgaaacattagctcttagatattacagacgtgaggtatctcttccttgaagagaatctggccctgatcaaaaactttattttgatactgttcgaaaagagaaataaggacaacgttctaatttatacaaatataaccagtaggctttatcgtaaaatcctcgaacttgcttctcatcacagaagtataaaaagtaaagaggtcaagcaagaaacgaataaccaccaaatttttttcaattgaaaagcgaaacgtaatggaaattcacctgctttgaatcgttgttgaattcttatcatcagtcattattttcctcttttaaagcttaagtcaaccgcatctaagtttaacacttcgttcccgttttgaagtttatcaaaattccaaaatacagtagttaggtgctcgtgacaaacctttttccaaagtgtcattagacttcatggaactactacacttctggggaacgaaaagctaccatttgctcatcattggataatttcttttttttttttgatgcatccaaacttggaccccttttgaatgtcgagtatgaagtatcaattttagggcaagtagttttacaataattttggtgcacttttacgtctctgctgatatttttaatactagtgcaaaagaattcgaaataaatataaaagaacaaggaggattaacatactttaaataactaattatcaccattatttcaagtttcaagtactgcgtatggcatgcacagcagatttctactcaaaaacatcctaagcgaaccacactagatcttacgttagtactgctgaaaatggcaataattgttaaagcaaaaattggcgatggttcattaattgctaaacaaaatagggcatttttcctcgttaatgataagtactcatacttctgtttctataagtgttagttgtaacttatgaaatatcgatttaaattcgaagtgttgtttgcaggatataaatcaaaaaaaaaaaaaaaaaaaaaaaattaaataaataaataaaataaatacaatgatatcgataacggtgaaattcttttcatggatttttgttgcccaagaaaataacaataacgttttctttatgatacatatatctactttttcaaaaaaggaagcgcaagaattatcatttagttcaatttgaatatttgaaagtttggaggagaaacagttaaaaaataattcatgtcagcgtatatttagcaaagaaaagatacacagatacgtaaaaagaacgcgaattttattaaataattgccagcaataaggacgcaatgaagacacttaaaccactaccggccagtaagctgttggcactgccagcatacgttgaaatttctaaagaagctgtactagatcctaccatgctacttgctggtgtgctacgaggctgttgcgacatagtactcaacccggaacttgttagactcttggtgttgccagtttcggatacagaaacaacactactgctgtgaccaatcacatcggtcgcggaagccgtctgtgtttcagcatgattgaatcttgaaattgaagaggtgactactgttttcgtctcagcagctccagtactggtagttgtctcagcagctccagtattggttgttgtctcactggtagcactgttcattttagagctgacagactgttcattcgtagtctgtggcctccatgtagaatagaccgtaacaacatcattcacagtagccgtggccgtcgaaacaatggcaggtgaagtagtttcggaacacacaccagatccgcaggaagtaacagtaactagcgtagtttgttgcttcgattctgtggtggaaataggacaccatgttgtgtattctgtggtaacgccattaatagtagcagtgcttgtagatacaatggctggagaagcagtcttagagcatacgtcagattcacaagaagaaattgtaactactgtggtttgttttgttgtttctgtggtttgctctgttgtccccttggtttgctttgttgtctccgtagtttgctttgttatctctgtggtagaaatagggcaccatgtggtatactctgttgtggcaccgctaacagtaacggtggccgtggaaacaatcgcagaggagatagattcagtgcacacatgagattcgcaggatgtcacggtaaccaaagtggtttgttcgctcgtttttgtagtggtaacaggtggtaatgaagaagtaatttcctgacttgttgttgcactggtaacaggtggtaatgatgaagacgaatatgtagactttggtgattcagaagagatagaagaggaagaagaggcagaactagctgaacccgtttcgctctcagaagaaccagaggtggaactactggttggaatgacggatgatttagatgattcagagagtatagaagcggaggttgttgtagaagaaatgacaggggaagaaatgaatgaagaagaaatgactggagaagaagtgactagagaagaagtgactgaggaagaaatgactagagaagaagtgtctgaggaagaaattactgaggaggaaatcacagaagttccattgctaggatagaatggggtaataattggacgcgcagacgtgataaagctggtgatttgtcctgaagaagatgacaaactggatgagatggcagtagttggagttttgacaataatgacagtttcatcagttggttgaccgttggttccagtgatggtggtcatctcagtagatgtagaggtgaaagtaccggtccatggctcggttgtagttgtaaccaaaccttcactggttggagttctgataacaatcacggtttcgtcagttggttgaccgttagtaccggtgacggtggtcatctcagtggatgtagaggtgaaagtaccagtccatggttcagtggtggtgctgattagaccttcactagttggagttctgatgacaatgacggtttcgtcagttggaacgccgttggtaccggtgacggtggtcatttcagtggatgtagaggtaaaagtgtcgttccatggctgagttgtagtcatggcagtagtggctgttgttggtgttctgatgacaatgatggtctcatcagttggcaaaccgttggtaccggtgacggtggtgatttcagtggatgtagaggtaaaagtgtcgttccatggctgagttgtagtcatggcagtagtggctgttgttggtgttctgatgacaatgatggtttcatcagttggcaaaccgttggtaccggtgacggtggtcatttcagtggatgtagaggtaaaagtgtcgttccatggctgagttgtagttatggcagtagtggctgttgttggtgttctgatgacaatgatggtttcatcagttggcaaaccgttggtaccggtgacggtggtcatttcagtggatgtagaggtaaaagtgctgttccatggctcagttgtagttatggcagtagtggctgttgttggtgttctgatgacaatgatggtttcatcagttggcaaaccgttggtaccggtgacggtggtcatttcagtggatgtagaggtaaaagtgtcgttccatggctgagttgtagtcatggcagtagtggctgttgttggtgttctgatgacaatgatggtctcatcagttggcaaaccattggtaccggtgacggtggtgatttcagtggatgtagaggtaaaagtgtcgttccatggctgagttgtagtcatggcagtagtggctgttgttggtgttctgatgacaatgatggtctcatcagttggcaaaccattggtaccggtgactgtggtcaattcggtagaagtagaggtaaaagtgtcgttccatggctgagttgtagtcatggcagtagtggctgttgttggtgttctgatgacaatgatggtctcatcagttggcaaaccattggtaccggtgactgtggtcaattcggtagaagtagaggtaaaagtgtcgttccatggctgagttgtagtcatggcagtagtggctgttgttggtgttctgatgacaatgatggtctcatcagttggcaaaccattggtaccggtgactgtggtcaattcggtagaagtagaggtaaaagtgctgttccatggctcagttgtagttatggcagtagtggctgttgttggtgttctgattacaatgatggtttcgtcagttcgtacaccattggtgccagtgactgtggtcaattcggtagaagtagaggtaaaagtgctgttccatggctcagttgtagttatgatggtgctagcagttgttggagttctgatgacaatgacggtttcgtcagttggaacgccgttggtaccggtgacggtggtcatttcagtagatgtagaagtgaaagtaccggtccatggttccgttgtagttatggtagtactgacagtataatttgaagggtctggaatggtacagtttggctggcttagattgttgtcaaaagtatatacgtacccttcaaagtcatcactaacggtagtgccatctggtagtgtcacactaattggaagtgtaccccaggcaacggcatttgagtaaacaatcttcattggataatagaaaccagcatacatgtagacagtccctgtaatattatcagggggacttccattccatggcttgataccattgatggtgaagttagtcgacgtgatgggaggttgttcttgtgcacaacattcgaacgcaatgctaccaccgactgatagaattgcagagtcgtcaactgtagcaaacttgaatgtgtaagaacccgtctgtggtggtaaaaaataacctgtcatttctagggttacgtttgttggggtagtatagaaaccaaataaatcagtactccagtatgcaattattggattattagaacaagcaccaattcctttgcatccccaattaccatataaatcttcttgaggacaaggaaatgtgcctgatgaactaacacaaggaatattataatcaatcgagatatcagtttgtcctccgacagaacccagtttagtttttgaggcatatccataagccatatatgctgcattcgaatatgtggaggaatctctcaatgaatactggtaaaagtttacattcataccattcttccttgagtttgctggcaggcatgccgctgtagtcgcagagacaacattagttaatcccagcaatgtgacgatggctagtagtaaacaataatgtgccagagacatttttggggcttttattgtacaattgttctttttaaattgcaatttaaagagcgtacctgtaaataagaaggaagaacgttatgttattaatggactttttagtgtcatcgaattttatgtaatatataagaaggtagaataatttggcaggataatgtgttagcaaaggaggaaatcgaatacctttaaaagagaaaaaattttttagctgcttaaatttctgtgttataccacccgatagattttgagttatgctttctaattgatctgactgcgaacgttttctttatgccatctgaattgtcaggaacaaagaagaaaaagaaaagtttttaaaaaatctgtggtcgtgtgtgatgtacctttcctttacatgcattaatgcgctctgaaatgtggtacgatatccttacagagaatatattttctgtatatcgtgcaatgttgaataacctatgaaggaaagtacccatcgctcaaggtaagcattccaggagggtcgccagaaacttaaactagttttagcgacagatccgaaaattgatagagacattgaaaaaatcactactccgtcctttttagtgctttctcaatgcataattttggtgcacgactaaaaaattctagaacactatagttgcattttttgggccggaagaagaaaaacgcatgtaactttaatgtcaaataaagttttcacctagtaagcgcgatacaaaaaaaacacagaaatagccataggaaagtgaattttgtcagccgactaaaattaaggttagcttacaaagcagcaaaaaatttgacatcgcacggtattccctgaaaaaggagcaggcaggtgctgtatatttttttcggttcctgcctcttacatggcgtcggtgtatcttaaatactaaagtgagctgactacccttttgagtgccctatgtgacctctgatctcgaaagtaaacaagagatacctaatttcacagccacttttgttgcggacactgacgggatgtgttgtgaatattttaaaccttaaaagtatttattggttagttatacttaattcttatacgtcctttaaaaccagtgtgcagtaagtctgtcacacaaaaatatgattgatgcattttcaaaaaataatggctttgaggtaattcgttccacttttgagacttattcacatgtcccagctgggtgcaatcaaaatataccggcatttcagcaaggtaactatatacgctttttttctcatggtttttgaaatcatacctgccaagcttgctgcacttggaaaggcaactccgtttttcagagattagatcctttaattttttttgatgaaaaaggcagccaagttacgtcatagagaaaactccctagagcgctgcaaacacttgttagtttgcagcttacttcacgtgtggctggaaaattgaaaagttacaatacggtaaaaatactttgaagacactacactataactgcttgaccaaatttttactcgtgaaaaatttgttccagccggtctgttactgatattaagttaaggaatagtaaaccgtatatttttcatccacgtttttgtagtttattttcggtttactagctatgcattgattgtctatcagagcatatcaaggtggttatggaggtgctgatatttaatcaataaaattatagaaattttgagaaaacaataatgattgtttctacaatgaaaatcagttcatggaatagttgccttcgcactactttttcaccagattaatggtgcatcagagctttccctttttgtctttttcttgtttcctttttcgattggtttatcacgtaagtttcttatgacataagaagaggcaagaaacgaaaagggaaatattgcctacttttttcttttcgaacgtaaataatgacgggattttggtgtcattttttttcgtctggattttctcagagaagtacgtttcgtcgcacaagctaaaatcattgacagggcatgagttacgtcaatctctggtcaatccatgtccaaaaaaatttcttgatttgttcaaagtttttgcataggcacattaattggtttagcgaagtatacattctgaagaacatttttgggtgtattttccacatagaaaattcgatttttttttttcaatgcaccacttgtcgagtatacgttaactttaatgtattgaagatgcaaaaatgaaaagcctacttggcatatggaattacaataaatggtcaattcctgtttaagctagcagcggcactgtcggtgtaaatttgggtttaaactattgtttacttactttgagaaatttatgtatcgcctatatttttcaataagtgcgatatctttagctttccacagaaccccccctcaggctatggacgtgcggttatatgatcttctaataaaaatctcttagactacggttcatggaatacttcttgacttcttggcgaaggaaaggcgcataaatgttgtgatcgaatgaccagtaatacgtcgtttgttctcttgctgaacagcgaggaagagatattcatccaaatgcatgaacgcagaatcctgtaaaagtcgtaaaaatgttaatcgcaatgttgtaaaaaccgtcaaggcatttatcgttcaaaatggcgatcattgttactactaaacacttactgttaaattaaaaagctgatgttgcgtaatccattgaccaattcataggcaatgtatttcaatgacgcacaagattcataacaaattttttatttacgatgtacctgtacattgtgcagaaggtcttcagagtgagtttaagctaggctgtaaatattttaatgttaagatgaaatttaagtgagctggtaatatcaagtgaggcataatttgttatatgtagctgaacttcaactttaaatagaaaaattacaactaacaagcaccggattgtttcagaattcaaagtgtagaagctattattcttgcaaaataaaacgctttcaaagttttcttctataaacatacttgtggcagcttgttttttttgttttatttttaagttttgttgggtctctgagaactttcaaaaaaagaaaaagtaaagtatgataaaacggagcacttgccaaagtaattaacgcccattaaaaagaaggcataggaggcatatacatatatatatatatatatatatatggctgctgacagatattctgcacttaaaaactaaaaatattataccaacttttctttttcttcccgttcagtttgcttgattggcccagctctttgaagaaaggaaaaaatgcggagagggagccaatgagattttaaagggtatattacttatcttatcgataagcagtattgatattaaagggacagttttatcgttggttaatatggaaaaagtgatgaccatgatgcctttcttaaaaagagtatttctttttatttcactttcacataaacagttaatgacttctgactttgagccgttcgaactcagttatataaaggtacatacataggccacacacacacacacacacacatatatatatatatatagggaagtagcaacagtcaccgaaaagaaaaggtaaaaagtaaaaaatgacaagcgaaccagagtttcagcaggcttacgatgagatcgtttcttctgtggaggattccaaaatttttgaaaaattcccacagtataaaaaagtgttacctattgtttctgtcccggagaggatcattcaattcagggtcacgtgggaaaatgataatggcgagcaagaagtggctcaaggatacagggtgcagttcaattcagccaagggcccttacaagggtggcctacgcttccacccatcagtgaacctgtctatcctaaaatttttgggttttgaacagatcttcaagaatgcgctcactgggctagatatgggcggtggtaagggtggcctgtgtgtggacttgaaaggcaagtctgacaacgagatcagaaggatttgttatgcgttcatgagagaactgagcaggcatattggtaaggacacagacgtgcccgcaggagatattggtgtcggtggccgtgaaattggctacctattcggcgcttacagatcatacaagaactcctgggaaggtgtgttgactggtaagggtttaaactggggtggctcacttatcaggccggaggccaccgggttcggcttagtttactatacgcaagcaatgatcgattatgcaacaaacggcaaggagtcgtttgagggcaaacgtgtgacaatctccggaagtggcaatgttgcgcaatatgcagctttgaaagtgatcgagctgggtggtattgtggtgtctttatccgattcgaaggggtgcatcatctctgagacgggcattacttctgagcaaattcacgatatcgcttccgccaagatccgtttcaagtcgttagaggaaatcgttgatgaatactctactttcagcgaaagtaagatgaagtacgttgcaggagcacgcccatggacgcatgtgagcaacgtcgacattgccttgccctgtgccacccaaaacgaggtcagtggtgacgaagccaaggccctagtggcatctggcgttaagttcgttgccgaaggtgctaacatgggttctacacccgaggctatttctgttttcgaaacagcgcgtagcactgcaaccaatgcaaaggatgcagtttggtttgggccaccaaaggcagctaacctgggcggcgtggcagtatccggtctggaaatggctcagaattctcaaaaagtaacttggactgccgagcgggtcgatcaagaactaaagaagataatgatcaactgcttcaacgactgcatacaggccgcacaagagtactctacggaaaaaaatacaaacaccttgccatcattggtcaagggggccaacattgccagcttcgtcatggtggctgacgcaatgcttgaccagggagacgttttttagccgtaagcgctattttctttttgttcgtaactatctgtgtatgtagtagtgtaatctacttttaatttactatgcaaatagggttcagcattacggaagaaactgaaatcccttccgcggaagtttcttagtagtggccgtgcggggtgaggagattacatgtcggtaattagatgattaacctaggcaatttgaagggggatagtggcattggttagctcagatatgataaggagaactaagcaagggggttaaccaccacggctgtagcacaagaccggcagatgcgattattagcaacacattagttaatgcttttgataaaatgtatataaaggctgtcgtaatgtgcagtagtaaggacctgactgtgtttgtggttctcttcattcttgaaccttgtcattggtaaaagaccatcgtcaagatatttgaaagttaatagacagttaacaataataacaacagcaataagaataacaataaattcattgaacatatttcagaatgagagccttagcgtatttcggtaaaggtaacatcagattcaccaaccatttaaaggagccacatattgtggcgcccgatgagcttgtgattgatatcgaatggtgtggtatttgcggtacggacctgcatgagtacacagatggtcctatctttttcccagaagatggacacacacatgagattagtcataacccattgccacaggcgatgggccacgaaatggctggtaccgttttggaggtgggccctggtgtgaaaaacttgaaagtgggagacaaggtagttgtcgagcccacaggtacatgcagagaccggtatcgttggcccctgtcgccaaacgttgacaaggaatggtgcgctgcttgcaaaaagggctactataacatttgttcatatttggggctttgtggtgcgggtgtgcagagcggtggatttgcagaacgtgttgtgatgaacgaatctcactgctacaaagtaccggacttcgtgcccttagacgttgcagctttgattcaaccgttggctgtgtgctggcatgcaattagagtctgcgagttcaaagcaggctctacggctttgatcattggtgctggccccatcggactgggcacgatactggcgttgaacgctgcaggttgcaaggacatcgtcgtttcagagcctgccaaggtaagaagagaactggctgaaaaaatgggtgccagggtttacgacccaactgcgcacgctgccaaggagagcattgattatctgaggtcgattgctgatggtggagacggcttcgattacacatttgattgctccgggttggaagtcacattgaatgctgctattcagtgtctcactttcagaggcaccgcagtgaacttggccatgtggggccatcacaagatacagttttctccgatggacatcacattgcatgaaagaaagtacacagggtccatgtgctacacacaccacgattttgaggcagtaatagaagctttggaagaaggcaggattgacattgatagagcaagacatatgataacgggcagagtcaacattgaggacggccttgatggcgccatcatgaagctgataaacgagaaggagtctacaatcaagattattctgactccaaacaatcacggagagttgaacagggaagccgataatgagaagaaagaaatttccgagctgagcagtcggaaagatcaagaaagactacgagaatcaataaacgaggctaaactgcgtcacacatgattgtgattgagtactcacgttctcgtgttaatcccgcggtcttcttgttttactaacttttctttctctcatagcattctcttgacagtgttttatatacatcatatgtacatttatcgagccaatcgagggcagcagtttaacatcaagccggatttgctcacgctactttgaccccttttcgtttcgacggagagaagaaaccggtgttttcctatccttgcctattctttcctccttacggggtcctagcctgtttctcttgatatgataataggtggaaacgtagaaaaaaaaatcgacatataaaagtggggcagatacttcgtgtgacaatggccaattcaagccctttgggcagatgttgcccttcttctttcttaaaaagtcttagtacgattgaccaagtcagaaaaaaaaaaaaaaaggaactaaaaaaagttttaattaattatgagagctttggcatatttcaagaagggtgatattcacttcactaatgatatccctaggccagaaatccaaaccgacgatgaggttattatcgacgtctcttggtgtgggatttgtggctcggatcttcacgagtacttggatggtccaatcttcatgcctaaagatggagagtgccataaattatccaacgctgctttacctctggcaatgggccatgagatgtcaggaattgtttccaaggttggtcctaaagtgacaaaggtgaaggttggcgaccacgtggtcgttgatgctgccagcagttgtgcggacctgcattgctggccacactccaaattttacaattccaaaccatgtgatgcttgtcagaggggcagtgaaaatctatgtacccacgccggttttgtaggactaggtgtgatcagtggtggctttgctgaacaagtcgtagtctctcaacatcacattatcccggttccaaaggaaattcctctagatgtggctgctttagttgagcctctttctgtcacctggcatgctgttaagatttctggtttcaaaaaaggcagttcagccttggttcttggtgcaggtcccattgggttgtgtaccattttggtacttaagggaatgggggctagtaaaattgtagtgtctgaaattgcagagagaagaatagaaatggccaagaaactgggcgttgaggtgttcaatccctccaagcacggtcataaatctatagagatactacgtggtttgaccaagagccatgatgggtttgattacagttatgattgttctggtattcaagttactttcgaaacctctttgaaggcattaacattcaaggggacagccaccaacattgcagtttggggtccaaaacctgtcccattccaaccaatggatgtgactctccaagagaaagttatgactggttcgatcggctatgttgtcgaagccttcgaagaagttgttcgtgccatccacaacggagacatcgccatggaagattgtaagcaactaatcactggtaagcaaaggattgaggacggttgggaaaagggattccaagagttgatggatcacaaggaatccaacgttaagattctattgacgcctaacaatcacggtgaaatgaagtaatgacaaaataatatttggggcccctcgcggctcatttgtagtatctaagattatgtattttcttttataatatttgttgttatgaaacagacagaagtaagtttctgcgactatattatttttttttttcttctttttttttcctttattcaacttggcgatgagctgaaaatttttttggttaaggaccctttagaagtattgaatgtgggaacaaagacgacaaaaggtagttttttccttgactatactggtaagatatcgtctaaaacaaagcatggccaagaaaatatcaaagaattcaagagctgctagacaatcggatgctcttgaaccagaggtaaaggatttaagtgaactacctagagctgaaaaaaccgatttgactaatattttgattagaacagcagccaagaatgaggcattgctggaagcaaagatatctaagaaagccaataaaagtaagaggggcaagaagttaaataaaaaggctctggaagacaaactggacaactctatttcatccatggacagggatcgtttagtgaaggccttgaattttaccaatcgtctggacggtaaaattgccaagtccatttctcgtgccaagtacattcaaaatacaagaaaggctggctgggatagcaccaatgagactataaaaaaagagctggcttttttgaacggagggttgtctgtgcaggcaaaaagtgctagtgaaggtaatgctgaaaaggaagatgaggagatcccagaagtttttgactctttagcagaggataacacagtgcagaagactcctacaaatagattcggtgtcctgccagacgatgttgaagaatagaaaattttcatatgaaaggtcctaggaatacacgattcttgtacgcattcttcttttttctatcttctttcattctttgtacattagataacatggttttagcttagttttattttattttttatatatctggatgtatactattattgaaaaacttcattaatagttacaactttttcaatatcaagttgattaagaaaaagaaaattattatgggttagctgaaaaccgtgtgatgcatgtcgtttaaggattgtgtaaaaaagtgaacggcaacgcatttctaatatagataacggccacacaaagtagtactatgaaattttctgcgtatttatggtggctgtttttgaatctagcgttggtgaaaggcacttcattgctatccaacgttacattagcggaagattctttctgggagcattttcaggcttacactaatacaaagcatttaaaccaagagtggatcacaagtgaagccgtcaacaatgaaggctctaaaatatatggtgcacaatggcgactatcacagggtcgattgcaaggatccgcatgggataaaggaatcgcagttcgaacaggcaatgccgcagctatgataggacatctcttggagacacctattaatgtttcagaaacggataccttggttgtccagtacgaaattaagttggacaattctttgacgtgcggcggtgcgtttattaagttaatgtctggtttcatgaatgttgaagcattaaaacactatgcacccgatacagagggtgtcgagttagtttttggtccggattattgtgctcctgaaataaatggcgtgcaatttgccatcaataaggttgacaagatcacacatgaatctaaactaagatatttgcaagagatgcccctgtcaaaattaactgatacctcgcaatctcatctgtatacgctcataatagatgaatcagcgcagtcttttcaaattcttatagacggtaagacggttatggtaagagaacatatcgaagacaagaaaaaggtcaattttgagccacccattacaccgcctttaatgattcctgatgtttcagtagcgaaaccgcatgattgggatgatcgcatccgaatcccagatcctgaggcggtgaagctcagtgatcgggatgaacgagacccattgatgattccacatccagatggcactgaaccaccagaatggaacagctccatccccgaatacattcttgacccaaatgctcaaaagccctcgtggtggaaggaacttgagcacggggaatggataccgcccatgattaaaaatcctctttgcactgcagaacgtggttgtggccagcagataccagggctgataaataatgccaagtacaaaggtccaggcgaactcaatgaaatcataaatcccaattacatgggggaatggcatccaccggaaattgaaaacccgctatactacgaagagcagcacccattgcgcatcgaaaacgttatcagtggtgtgatcctcgagttttggagtggatctccaaacatgttgataagcaacatttatgttggtaaaaatgtaacagaggcgcaaattattgggaataagacttggctgatgagagaccgcgcgtttagaggctccgatggccccacagaacgcaaattcatgaatagcagactaggaaatctacaaacaactttccataacgaaagagaatcccctaatccatttgaccgcattatagatcgcatattagagcaacctctgaaatttgtgcttactgcggccgtcgtgctcttgacgacgtcggttctttgttgtgtagtatttacatagtggacaagtgttagtttataacatggtctcaataattgcaccacaacggcttctcttttatagatggttaacattatagtatcaatattatcatcatgattaaatgatgatgtataatacttacccgatgttaaatcttattttttcatgcagtaagtaatcatgcaacaagaaaaacccgtaattaagcgaacatagaacaactagcatccccgataagacggaatagaatagtaaagattgtgattcattggcaggtccattgtcgcattactaaatcataggcatggaaatttccagttcaccatggaacgacggtggatacagcccctatgagagaaacagagtcgctgtatcaccattttcatcagcgttggaaggcgaagaacgaatagaaacctctcgatctttgggtgatcattgctttgaacctttgccatacgtgacgaattatctttctattttcgcgctttttggtaaagagatatttggtgacaagggaaatgtgagctcaagaaatgaatatttgctaaaaaaatactactctttgaaaaagccatttgtattgcgacataatgggcatgcgttgaagaatcccgacatgccactccagaggaatgacatattgcaaaccaatttcatggttgacaaatttctgaatcgtactgtgcggtcagtgaattttaataatttcaagataatatcagatatgcaaagtaaaagcggtcgaggaacaaagtcaggcacaaatcagaatcaaagtgccgacgctattcaaaatatttgtctaccatctataccgtcggcgttgccttatttccagtattataggaagctattgacagttaataccaaagaatgggatattttaaaactgcacagtttatgggtaccaaagctaaggaaggattttaaagatttttcgttgtatggtgataaaaactctttaaagccgatcgatagtcactatgatgaggataataccatgaagaaaaatttattttttgaaagatctccaagtcgacagactctagatggtaaagggtgtgcctctaaggggtatgacatttcttccggtaatatgattatcccatccctattttctgaagataagctgccggctttaacttatcattgttccgtagaattaaatggaaacatttacatatttgggggattgatgccatgctacagctatgaggaggatgcgccgatgctgaacgatttttttgtagacggaataaagaacttacctccccctttactacctcaagtgattaataatccatcaatggtcaataatcctcatctttatgtcgcttctataccatcatgccggtttagcaaacctaaaatggggggttatataccgcctccattgctatgtgttcaaggatccaaattaacggaccgacatattttcttttatggcggatttgaaatcaggacagaaacccgtggtgatgaaaatgggaagtatcatctcaagaaaagattatatgtgaataacactggttacatactcgatattatgtcgttcaagttcactaaaatagatatcatagtacaaccttccaaatataatgcatatccgacaatgtcatcgaggtttggtcacttacaaatttctattgataatccaaataggagagctagcgttcattcttcaagcatgaacgaaattcataaaatggggagtgcttccatgaaacaaggtagcagcatcacttccgggcggcttgaaaaagcagcagtactttcatcattacctcataatactgtgcacacggttataatatttggtggttacagacaaaccggtgatgatcgttacgaagcaatgaatgatttgtggaagatagagatacccgtgatacgtcgcggtaaaaaaggttattgtaagttttcagagacagctaacgcgatactactgacgccaagcgaaaaggacaaatcggattggcccgaagaaagagccttttctgccttttctgttcatgggacttcgttaatggataggagttctcttgacatgagactattgaacaacttaaaaaaccattttgttttaaaaccgtcatatatatcacaggatcgcgttgttagtcctaaaccggttttccccatgatggttcatggcacgcatcaagatcttttcaatagtggctctgcggcacaagaatcgcccaaagctggtgcctcggccagcagcgcaagtgctgcgagctttgatcccgatatggacgataatttggaaaattatataatcaatccagggagaaaatcgtcatctattccaatgactgcgatagggagacagagattaattttaagccaagagaagccagtaggtaaaactgttgtattgcatggtgggtctaacggtctcaacgttcttgatgatatgtggttgatggacttagagtgtgagacatggactccaatagagacatttgcaaaggcagattcgagcgaagacggtgatgaaaaattggatagtgtgaacgtaggtctcgttggccacagaatggaaagtattggacgaatatgtgtatgtataggtggtatggtacaagaggatgttgaccaattttactcggagaatgatgatgagcctcctcgaaaacgcaaggtcgatacattaccgttgggtggtaattttttgaacacaattgatttaagcacgcagttttgggaagaacataaaattactctgtccaagaaggcagccgatgaggacagacaagatagcgaaaatgaagatacaaattcaaatatagtagttggtgtcggtggcacttctttcaatgtgacaaaagtattattttgattggcggattgatatctagacggagcaatgtaaaagaaatatatttacatggtaccataacgaaaagtatttttcctagcgtaaatcctagtgcataaaaaggcagttttcaatgctttcactttgtaaactttgtttagtagtagaatataatatattcagttttgttttatagtcacataacactttgtctttcaaagaataatctccttcgcaataccagcgaaatattttggcaaaaaattaacaattaggttcatagtcccctaattcaattaatcgaaaaaaaaaaaataaaatataagggaagattgtgctgatgaaatagacaatgaaacaataatgaagaataaagaagaagaagatataaaacatgccaccaccatcaagaagtagaataaacaaaacaagaacattaggaatagtgggtacagctatagcagtgttggtcacgtcctactatatatatcaaaaggtgacaagtgcaaaggaagataatggggcacgacctccagagggtgattcagtaaaagagaacaaaaaggcaaggaagagcaaatgtattataatgagcaagtcgatacaaggactgcccataaagtgggaggagtacgccgctgatgaagtggttttgctggtacctacgagccacactgatggatcaatgaaacaagccattggggatgcctttcgcaagacgaaaaacgaacacaaaatcatatattgcgatagcatggatggattatggtcatgtgtaagacggctaggtaaatttcagtgcatattgaactccagggacttcacaagtagtggtggtagcgatgcagcagtcgttcctgaagatataggcaggtttgtcaaatttgttgttgatagcgatgtagaggatgtgctgattgacactttatgcaattaatgtagaaaagagtttcttgtaacagtatgtaaagaataaataattataagtataaataaaaagagaaggtgaaataataataagtaagcagctcggttataagagaacaaaaacacacgaaaaaaaaaaagtcgtcaatataaaaaggaaagaaatcatcattacaacttgaccgaatcaattagatgtctaacaatgccagggtttgacaatgtagaaacgtcgcctagttggtcactttctcctgctaggatttttcttaaaatacgtctcataattttgccggatcttgtcttgggcaagtcatccactaaaatgatcaattttggtgcggcaaatggcccgatgtcttttctaacagtaaagaccaaatgcttcttgatatcttgtaattcatcatctgttgcggtggaccaactagatttgtttttcaacaccacaaatgcagcaactgcttgaccagtcaagtcatcgttgaatccgacaacagcacactcggccacaattggatcttcgataatagcagcctcaatttcagcggtagacagacggtgaccagagacgttcaccacatcgtctacacgacccaaaatccagatataaccatccttatcctttgcagcaccatcaccagtgaaatagtagccagggtaagggttcaaataagtgtctagatacctatcatgatttttccaaatagttcttgcaaatgatggccatgcagctttgacggcaaggacaccctctgcgtggctggtgttaagttcttcaccagtgttagggtcaagaacaactgcatcaataccgaagaaggggaatgaggcagaacccggtttcattggtgtaacaccaccagccagcggggtgaccagatgcgaaccagattctgtttgccagtaggtgtctacaatggggatttcatttttacctattttttcagagtaccactcccaaacttcagcagcaattggctcaccgaccgaacccaagcaacgcaaagattttaaggaatgattttcgatgtaggaatcaccagctcttttcaacaaacgcaaagcagttggcgcaacataaaattgggtgactttgtgttcatcaataatatcccaataacgggagtaatttgggtacgcaggagtcccttcaaagaccaaagtggcacaaccatatagtaagggaccataaaccacataagtgtggcctgtaatccagccaatgtctccagctgtgaagaaaacgtcttcttggtgagtgtcaaaagtgtagcgcatggtcaacaaagctcccagcaagtaacctgcggtagaatgttgaacacccttgggggcaccagtagaaccagacgtatacaacaagaataatggatcctcagaatcaacgggtgtgcatggatagtaggtcttgtatttcttcttttctgttgcccaatccaaatctctgggggcatggaaagcaacagatggattgttggtctttctataaaccaagacgtgtctcacgcctggggtctctcttagcgcgtcatcaacaattcttttagtctcaatgactttaccacctctgttggattcatctgtagtgatgacaactttagagtccccatcgttgatacgatctctcaaggagttggaagaaaacccggcaaagactacggagtgaatggcaccgatacgggaaatggccaacaaggttatgattgcttctgggaccataggcatgtacacggcaacagtatcgcccttgcgaacgcccatagagtaagtcagcacttgtgccacttgacaaacttcttcaagtagttccttgtaggtaatggaatagccttggccaggctcgtcaccttcgaaaataatggctttcttgttaggagtcttcaaggcatgtctgtcaacacagttgtaacaggcgtttaattggccgttgaggaaccatgcattgttctggaaggagggcctgcccgttttagggtctgggatgaacaccttatcgaatggcttagaccagtttaaaaattgggtagctttagaaccgaagaacttagcagggtcttcaatagactccttgtgcaagcgctgatagtcctgcaacccgtccaagtgtggagaatagtgggtagcaattgcgggctgcagtctatctgagatgggccgttgtggcacgatcttgaccgaagtcaaatgttcatactcatgttccttcttctgctgcgcagtggcggcagactgggacatttttgctttcaacttgtcaatttcacttgactgttcttctagttttgatgattgtacggcagagggcgacatagcacagtgggcaatgtctttctagtagttttgatatgtttggttttgcttatagatagaaaatataagaacaagatataacgtactaccagataacctaagggagaaatatgcttagaatagccgcccagtttatatacaaaatgaagggagaactatttgccaccgaggaactgtaccccaactgcaatacccattgaataatggcatcggaggctcggcggcaattcgtaccccaaccttttttttttacttttctttggatcttagagataacagaaaaaaaggatgaccccaatcatttgccacggcatgtcaacaggtgagtgccttttgaggggggggggtcatctcgacatccggcgaaatggagcagtcacacgtgaacatttttaggggatggagagtgctacgccgttcgtccgagatgattatcatatttacacagccgtacatacacgtgccatttatcttgatatcattctggacgtatgtgcacatgtgatttgcttttgtttttttaagaatgtcgggtaataaacagattgtttttctgggaggataatcttttcttttttcctgttggtattctaaaattaaccttgctgtttcttttttttttttttttcgcgcgactactcagccatcttgcatttttaaagaaaaagataatcattaatgccttcacgggaatacgtatagaacattattaaaagtatatgaatggcatatatatatagaacaccacccttggaaaacatttataccccttaaactaaaacaatttgctgcgctataccgtgtttcagtgtattataatacattcatttctgtttcattacgattatattgacgtgataaaaagattatatagccatgatcttcctaaacaccttcgcaaggtgccttttaacgtgtttcgtactgtgcagcggtacagcacgttcctctgacacaaacgacactactccggcgtctgcaaagcatttgcagaccacttctttattgacgtgtatggacaattcgcaattaacggcatcattctttgatgtgaaattttaccccgataataatactgttatctttgatattgacgctacgacgacgcttaatgggaacgtcactgtgaaggctgagctgcttacttacggactgaaagtcctggataagacttttgatttatgttccttgggccaagtatcgctttcccccctaagtgctgggcgtattgatgtcatgtccacacaggtgatcgaatcatccattaccaagcaatttcccggcattgcttacaccattccagatttggacgcacaagtacgtgtggtggcatacgctcagaatgacacggaattcgaaactccgctggcttgtgtccaggctatcttgagtaacgggaagacagtgcaaacaaagtatgcggcctggcccattgccgctatctcaggtgtcggtgtacttacctcagggtttgtgtctgtgatcggttactcagccactgctgctcacattgcgtccaactccatctcattgttcatatacttccaaaatctagctatcactgcaatgatgggtgtctcaagggttccacccattgctgccgcgtggacgcagaatttccaatggtccatgggtatcatcaatacaaacttcatgcaaaagatttttgattggtacgtacaggccactaatggtgtctcaaatgttgtggtagctaacaaggacgtcttgtccattagtgtgcaaaaacgtgctatctctatggcatcgtctagtgattacaattttgacaccattttagacgattcggatctgtacaccacttctgagaaggatccaagcaattactcagccaagattctcgtgttaagaggtatagaaagagttgcttatttggctaatattgagctatctaatttctttttgaccggtattgtgttttttctattcttcctatttgtagttgtcgtctctttgattttctttaaggcgctattggaagttcttacaagagcaagaatattgaaagagacttccaatttcttccaatataggaagaactgggggagtattatcaaaggcacccttttcagattatctatcatcgccttccctcaagtttctcttctggcgatttgggaatttactcaggtcaactctccagcgattgttgttgatgcggtagtaatattactgatcatcacgggacttctggtttatggaactataagggttttcatcaagggaagagagtctctcagattatacaagaatcctgcgtacctactttacagtgatacctacttcttgaacaagtttgggttcttatacgttcaattcaaagcagataagttttggtggcttttacccttattaagttatgcgttcttaagatccctgtttgttgccgttttacaaaaccaaggtaaggctcaagcaatgatcatctttgtcattgaactagcttacttcgtttgtctctgttggataagaccatatttggacaagagaactaatgttttcaatattgctattcatttggtgaatttgatcaatgcatttttctttttgtttttcagtaatttgttcaagcaaccagcagtggtttcgtcagtgatggcggttattctgttcgttttgaacgcggtgtttgctctattcctattattgttcactattgtcacctgtacactggcattactacacagaaacccagatgtccgttaccaaccaatgaaagatgaccgtgtgtcattcattcctaagattcaaaatgatttcgatggcaaaaacaaaattgatcctgaactgtttgaattgagaaaagctgttatggacaccaatgaaaatgaggaagaaaaaatgttccgtgacgacactttcggcaagaacctgaatgcaaacacaaatacagcaagactctttgatgatgagactagttcatcctcttttaagcaaaattcctctcccttcgatgcctcggaagtaacggagcaacctgtgcaaccaacctccgctgtcatgggtacgggtggcagcttcttgtctccacagtaccaacgtgcgtcatctgcttctcgtactaatctagcgccgaataatacaagcacctccagtttaatgaagcctgaatcaagtctctacctggggaattccaataaatcatattcgcattttaacaacaacggcagcaacgaaaacgcccgcaacaacaacccatatttgtaatccaatatatactcacatgtaacaacttattatataaatatttaagggcaaggatatcctacattatatttcatagaaaaccgctcaaaaaggtgtattatctccattacatcccaacaccacacatatttcagcgataaaaaccttaaatgtgaaattcgctttggctctgcttccttaaatgtacgcaattgccgcttttttctgacatcttttttgacgtgtagagaaggaaacagatcctccagaagggatttactgttggctattttgtgttagaagcaggttaataatagattaggttgcgtaagtcatggtcgaaaatagtacgcagaaggccccacatgccggaaatgatgataatagctctaccaagccatattcggaggcgtttttcttagggttcaataacccaacgcctggattagaagctgagcactcaagcacatcgcctgcccccgagaactccgaaacacataataggaaaagaaatagaatattgtttgtctgccaggcttgttggaagtcaaaaacaaagtgtgatagagaaaaacctgaatgtggtcgatgcgtcaagcatgggttaaaatgtgtttatgacgtatcaaaacagccagcaccacgaattccgagtaaagacgccattatatcaaggttggaaaaagatatgttttattggaaagataaagctatgaagctactaacagagagagaggtgaatgaatcaggcaagagatcagcaagtccgatcaatacaaacaatgctagcggggacagtcctgataccaagaagcagcataaaatggaacctatatatgaacaaagtggtaacggggatataaacaatggtaccagaaatgatattgaaatcaacttgtatagaagtcatccaaccatgatcatgagtaaagtcatgaaaagagaagttaagccgttatctgaaaattatattataattcaggactgttttctaaaaatcctggtcacttcagtgttccttgacacttcaaagaacacgatgataccggcattgacggcaaacgcgaatattacaagagcccagcctagcgtagcaaataaccttttgaaattgaaggaaatgctaatcagacagtgtcaaaccgaagatgaaaaaaatcgtgtaaacgaattcactgatagaatactacaaaatacaaattcaaatagaaacttgaaaatcggtatgctattatcaatgctttacaattctgtcggttaccaatatctggaggatcattgccctcaaggtggcgaatattcggatttattgagaaatttgatcaatgaatgtgaagctattttgccatcttacgaaattattgaacgctacaagaaccacttttatgagtacgtttatccaagtctacctttcatcgaattagaaatttttgaagaatcattaagtcaaacaatttttccggacccaaacaacccctccaaggtgcaaatacgtatgggtagcacacatttgagagctaaggtggaaaacttgagtcttctattggttatcttgaaactctcatacatgtcaataaggtttttagatcatagtacagcagactcgagtttttatctttcaaaggaaataattgataaatacccaataccgaacgattttattttattgagtccaagatgtctagcatcggaaaattggtgtgcatgcgctaatgaaaacatcatatcatgtttactatatatctggtctttttttgctttttctcctgaagagggtgatttctttctcgagcaccccaccgatgttatcagtagtttgataatgatgctttccacctcgattggtctccacagagatccttcagatttccctcaattgatttccccgtccacctcagataaaagaaccttgaatcacagaagaatactctggttgagtatcgttaccgtttgttcgtttgaagcaagtctcaaaggtagacattctgtctcaccgatatctttaatggccttattcctaaatattaaggatcctgattctctgacggtatatatgaaccgagttaggggcgatctaagcgatatcaataatcacacacttttgagaattcataaatttacattcaagagagcccagcttgcgttactcctgtcggacttagataacttgacgatgacatactatggtagtttccatttgcattcaattgaattcataagagaaaagattgagatttttgtggaggaaaactttcccatagtaccattaaaaagtgtcgcacaggataagtcagaccttgatgacatgaatgtgatttcagaaatgaatatattatcttcagaaaattcttcttcatttcacaatcgaataatgaataaactattgatgttgagaacttcaatggccgtattcttgcattttgaaacacttatcactaaggataaaagtatcttcccattctacaagaaatactttatggttagctgtatggatgcgttgtcactaataaattatttcaataagtttttcaacggagaatatcgacacgcaatatcttctttaaccagttttaatgttacaaaatttattcagttagcactatccagcacaatcttcagcctattagggattatactaagaataggtttagccatccatatgttatcttctgaagtacaaaagttatcgggaacgacagatccaagaataaaggagttaaataccaaagtcgaaaaatttagtaccctgcaaagagatctcgagtctgctttagaaggtatatattgctctgcttcggaacatttaagattcacatacttccccgtttttaagatgttggctttattcgatgtcattgtacaaaggatgagaaagggtgaattatggcacggcatatttacgatgattcaaatggaacaaatgcattctaggataatcaagacattaagcattaccttaggagtcaaactggacaaaaaggataggctattagaggaattgatggcatgcaatcacgttgcgaattttagcgttgaagatatagatgagctgaaccgtaatatcaaaaaagagattcaaatttcttcaggattgaagccgcctgtaaacacaattgacttaaccaacggcgaaccattcggaaatgctgttcctaccttcacaaagacatggagttcatccttagataatttagaaaaactatcatcggccgctgcagttggtcagagcttggactacaacagtggtttacgtcagggtcctttggcgggtggtggttcaaaagagcaaacgccaatagccgggatgaataacttgaacaattcaatcaatgctacaccaattgtcgataactcatctggatcacaacttcctaatggtttcgatagaggccaagcgaataatactccttttccaggttattttggaggtttggatttatttgattatgactttttggtttgggcaatgactttgcttaaaaattttctttccaaactcctacctattcatttcatcaattaattaatattatatagccacgaatttatgaaactgaccgataatataaagtgctcaatatatatatatatgtatataacggttaacgtaagaagagctcttccctcttaaacattcgaaaaatgattgaaccagtatatttggtcgagcaagactttctccttcgcatattttacggcaggtatggatatatcgcctcttgctgcaaacccgtgagccacaccactgaagaggtctaactggtaagtagcgtgattatcctttaatttttcctccgttaagtgtcttaagtttgccggaaagatgtgatcctcttccgctgctgaaatcaatattggtttcttgctatcaattgcttcaatttcctcgatgctgacgaaagatggatgtgcaatggctgcagcattggcaagacccccgtcgccactaatgtgttggacggcaaactttgcaccaaaacagtaacccacaacgccaataaactttgggtcatattcaagttttaacaacttcatgaatccatcaacaattttcttggtgacttcaggagaatgtctttgaaaccaggcatcacgatcaattggtttgtccgatgagatagcatcgccgaataaaatatcgggaacaaagaccatgtacccagcactagcaaatttgtcggccgttaataaaacattgttgaatttattgccatacacatctgtcaagataactataactttttccttgggagatgtagagcctgctgcataagtatctaaaccgaagatttcttcacgacgacccttgggtgttccatcgtgacaaactccttcaaagcaacacttgccaggttgattagatgccatttgattgaaataattttgttctgctgtagttagacgtagtggaaaactttaagtctactgagtcttgagaccttatcaccctttgaaggtttcttgcaaatgagcgtggtttggcattttttatcggaaagaaaaaaagggctccgccttaggccagatatcatagaaatgcaacacttccctaatatagaaatttgggcattaattattttgagaattttgatgatttgaataatttcattaacgtaaaggaacatagtgctacgaatccaacagtggacccaaaaatgagagccgtttgtctgtagtcgacatcttttgctgctgtttcttctggcaatcccggagtgtttttgccaggatcaagagcagcttctgtgattttaataaacaattcattaagggaacttagccatctggatgatatgtgcagtgggtggttcacaaatagctcgtctgccagttcatctggttggatttgacacctttgttgctgcttatccaaatctgccttagaagctacaaataccaacggtagatcttgtaaatgtgtgaatttgtctagaagcgaaactaagtaggagaatgattctgggtcgctggaatcgtatgttagacagattacgtcacattcttttaacttatccttattctctagtatggcgtattcctgttctccaagttcttgcaaaatcaaatagtactgtttcccacctttgagttctaaactattgactgcaattcttggtttgattgtcggagaatactcctccgagaaagatctgcccaagaaggcctctagcaaagagcttttgccgcaacatggctttccaatgacaaagcaattgaacacttttctgtcattgatattggatctgtaaagtttcccggaacggcgtctcattttccttggcttggttacttgtagggctagtcttgcatcttcctgaaagccaaaatacaccaagtaagcggtagttgtgctatagttcaagaaagtcgtcatactccattgtgctagccagccttgtaaggtgatgcaacccttgttgtttacgacagtggagaaggggaaattcgttgaggtccatagtttaggcagccctggtgtgcacttaaatagacgatgtaattcttgattattcaaaccaccatcattgtcgatatcaaacttcaaaaaaatatctacaagaaatctgtagcccttggggctcaattccacactggaagtgtcagggacaaccaacctcggatggagaattttgtcattaatacacaaggaatctgtgtaatggaaagttcttaggatagcccatgtagtttcgtgtctccccctttcagcgtatattttgttcagtacaaggaaaccatctttggtgatgccttttcccggtacgtatagcttgcggttaatgtactcttgatcgtgcttggaaatatccaaaagcaaatctttaataaaattcagttcgtttacatcgatactcttattgaagcactttttttgtaagcccaagatttcgttgtcatctaaatatgagtcctggtttaaatcgcttaaaagaaaaattctttttaaagccatgacagccaatggctttagttcacctaccatggcatcaaataaaggtgatattgggtgtgttatagccctttggcaaagataaaacgcttggttaagatcaaactgtgtcttggcacttgtcttaatgcaagtgtcgatttctttaaactccattaatattgggataaattcttcatcctccactttggtatcgatatcatcatcactgttctctgacacgaccattgcattggcattaacattcgatatggaatcacatttatttttgcagagaatgacaggaatattcaaccccagggatctgaaatgaggcaaccaaaagagagaaacatggtcatacgattcgtgatcgcaatacacaagccaaattacgtcggcggacttcaactcatggtctaaagctatgaggtccgaatctgaagtgtctataagtactgtattcttaggagaatatgtaggtgatgatgagaaatctcttgggatactgatgggtggcagcacgtcctgtatggtcggtatgaattcagcttttgttaatgatacaatcagactggatttaccaaccccttcatcaccgcaaataactacccgaatcgtttctttagtcattgtgttgttcaacacattagtatttagaagtccgctatttttgttttcaatttttatttgtttaatatacaaatttcattcttgttttgagggtaaaccactataccaaatgttgaagatctaaaggtatcgatcaaatatgttgctagagagtgactgagtgttacattaaatatatttatatataaacgtatgatatttagggattgttgattgataggttgaaaagtttcgatctcaatgactcattttcctgttctaaagccttgattcgagcttctgaagcgttagcatcgagcttccgtctttctctttcggatatccatcttctttgtaactcctctattcgtaaggtcagttctttatttggagttgccgttaattcattgccctgttgatgtggctgctctggggtttccatggaaatcagtgaagagatatatgagtttattatggactctaatgcagtctctataaaagtgtagagcgattctagtttgggctgaatcaaattcaagtttttcaacgcatttggtacagattttatggatttcattttcctgtcaaattgggcaatagaactttcttgtaagattttctgcagaatattgaaaatactgtcaaggtgtagtaaaaggttctgattaaatttgataaaattgctttcatattgggatagtattaacttttggttgtccaaagtatttaactgattttttaattggtaattctccaagtctaatttgtctaactgattttgtattacgtggaattcctctgatttatcgatttgaaggtcattgatttgtttttccaagtcattgatgtagctgtcccaattattttcctttagtttattgattttggtctgagtttccagttctttggttaaaactttttcattttgtttcattttaatgatgtcttccttcaatttttccaaattgtttatcaaaacagattgcgattcgatcttttccttcagttgggaaatcaaatgatcttgtttttctataacggaactagaattttcttccaattctaaggaatctagtagatgagactgctcatttagtttggacgctattattttttctaatttttgcgatttctcgaatttcaatctaatggaatttataaattgatcatattctttgtgcaaaatttctatgacaatctctaattgagtgtctaaggttttctcaaaacgagactcgacggctgaaattggtaaggaagtactgtttgccattacattttctgtatcaatgtggttgttactgtcatgaatttcgtcattctggtatccaccatcagtattctcctctttacttgatggtgagtccctactttctaactgtgatcctgctggtgaggactgggccagtgaaagaaattcttccttatcctgctttgattccgctcgacttttggaatgcaaaaagtcctgcaagaattggatgatgaacttggacaaagtatccattttttcaagaacataatccgagctcagctctaaagtttcctccagggtctccctctcttctttatcaagaagatgggcattttcatcttgctcattaaaatgcgtcaatataaaggacaataggtgattgatcgtattcacgatactttccgaattttctaaattctcttgaacgaattgtagcgtatcttggtactcgacttccttcgcctttaaatcctgtttcaatttgtttatttcaagatttagaccctcgataatcgaatttctaaaatcagtgtcattgcccagcgatggtgcattgccgtctttattagggattctgcgaatgtattcatagagtacttgaatcttgattttggcattagtcaactccttctccaaatttttgactttgttggaatcgttcatcagagcaggcttgatgggatcgttatgagatgacctcgtggtcatggagtccctgagtgatggtatggacatcccagaatccatcgagtttgtgaactcgctgtcgtcatcatcaccagtgttgtcattattgcgaagatgcctgccactaggaatccatcgacgtaccatggctataactttccttatgttgtttgcttagttttttgatattagtgttgcttatgtgaaatttcgcgatttcaattaaaataataaatacatatataaagaatatacacagagggaagcaaaagtaaactaaaagtgatacttacacgagcttttttggttccaaactgttcatgatgatgccggacccttcccagttgacttcttagtggtcaattgtaggccatgccatctggaaatatcgtccctcaaaattctgttcaccagctggtgctgcttgatgagactcagtccgttgaacttcttgcttgttatgttgatagcaaacatggatccgcagccaccggaaacgtcttgcactttacacacttcaggttccagttcctgttgtagtttatcggtgatcatcttctcctccggagtcattgccatctgcgttgagtaccaaagctttgagcccgtcagaatccttggccaccggacatgcttcacagatatagaacgtagcatggtctgtgggagcttcatttctatgttttaccttctcttttcgcttttatggttctcagtgaccaaataaagaaacttatatatgttccggaatgacgaatcaaaaagagaatagcatcgttagcagcaaacgaaagtggaaagagaataatgttcaagagagcaatgagcacagatggtcccgtggcacgtaccatcctgaagagactggaatgcggctttccagattacaagaactttgcgtttggcctctacaacgattctcacaagcataagggccatgctggtgtacagggaaatgtctctgctgagacacatttccggattgagatggtcagtaaaaagttcgaaggcctgaaacttccacaacgccatcgtatggtttattccctcttgcaagacgagatggctcaggcgaacggtatccatgctttacaattgtcactaaagaccccacaggagtatgaatccaaagcgaaatagaatgcataagcataagtgtacacgttgagtttattgttttatttcccctacatatatatacatatatatgaaattactttacgtacgtataagctttgttcagtcatcatgaaccagtgtcttttcgtactgttctaaggacattagaccctcgacctgttccacattaacgccctcaccaagcttcattttgactagccagccgtcacccataggatcttcgttcaccacacctggattttcctcaagattagtgttaatttcctctacggtaccatcggcaggctggtagatctcggaggctgacttgacggactcaatggaccctagcgactcaccttgggaaatctcagtgcccacttctggcaactcaacataggtagcgtcccctaaggaatcagtggcgtattttgtaattccgacaaaggcagtcttgtcctgatgcacagctatccactcatgttgggaagtgtacctcacggcttgaggtccttgggatgagtacaaaaatggtagtttattcttgtttagggcattgccggagctgtttctcaaaaacaatttgctcacagcgggcatgcgggtggtccatagtctagtagtgcgtaacattgtcgatgtggtatgcttcatgtggagattccctttcccattagatacttgtttgttggtctgtatatatagaagaaagagttagcgaaagtgactccgccgctgaatgactccttacggaagtgtcaaaattgcgaggtccctatagcacagaatgatagataaaacattgatttgcaagttgaaggaagaccctacacatgcgtatatatgatgtatgtaatggttgtgatcattttagcctgtcaagcagtgaatcgcactgcttgtgtaagccttcatcttcttgctttagctgatgcagcaggtcgcgaacagtgtcctgcactgggggtctaaacataatgagaaactttagcgtttggaaaccaagggaacttcttgccggatccaggcagataggcttcagtgcctcaagatgatcgctttgaagactgggcagttcgctcataagtctgatgaagaatcgtctgtgtttgttttcaaggaatggacccagagactcgagaactcttaaggaccattttttgtagttagagggatcttgatgcagcgaggtttggaagaaccattcttcattgagccattcaatgatcagactgacacgttgctcgaaatcctggatgaagaagccaagcagttcttcacgaatcaggtcactggcctcttgtgcttcgattcctctcgtaaccaatctgattaagacgtgtaaccatgacgaggagtcgtcatcgtccagtaatatggaggaggaagacgaagatttggcccgggtagtatcctggcgaccggataattcaaacagtttcttggtcagctttgagaggtactttagtttttcatcctgcgtcaatgagtcaggttcaaaggggggtgcgatctccttaatggcagaagttgatttgttggcatctcctgagatttcttgggcgctttcctcttcttgaagcatcttctgcattcggtcatcgtcttcgggctcctctggttcctccgctagtggttctgtttccattttgattttcttgctattagccgttgggccatcgtttccaacttcttcattgtcgttgccgtcgtcatcatcgtcggatttcctctttgatgatgacgaggacggtacagaattgatgtacgtattcattaaatccgtgtacctcgaagcaacgatagacaatccggtgatcagtttcgtgctgtccatttgcaagatggcctctgtggacagcttgataagtatgtcattgggtagctgggtcacatcctggttggagttcgaactgttcatcaatgagtacacagatgagtaggtgttgctgattggtttgggtgagttgttgaaaaaagtattgccctggtgtgaagccttgttgagggtgtatttttgcaatatcttcagttgatcaagcatgttttcggttgaagagcccgttgcaggtgcggacacaggcgtgggggtctttgtggacacccctagagtagacaataacgcggataattgccttttccatagtgagatgtattttagtttgtcctgcctggacaacgttttcttgctattgcccttggaagggtcgaagttcaaaattcccttgctcttggtctcttcgccaataacgtgtaaagtttgagaaatcttggtcagcttggagtagatcgatgaccctgatccggatgagagggattttgtaatgatttgattttttagcccaaattgcacaaagttcttgtacgccctttcaacaaatctcttggatagtttgtagttcaagtcagacttgccctctaggggaaacttggcgtcgacgttgaaacgcaacagcccggaaagaattcttattgttgtctgcggccttcttttgatgacgaaggataaagaattgatgataccaatgaaaacggacgagaccatgtactgttcctcaattaggtagtttagcaacatatcaagaagcctcttagcctcgctctccaaagccggtttgttcaacacagggtggttatccgggatggtagatgaattaatctcgttgccgctgggtgatttagtttgcgacagcacgacctcagatatgaacttgatggtcgctaatttcacgccgatattttggtcaatctgcgccagccattgttcgacatccgtttcatcgtcaacggtggcacgcaaaggatatgcagttctccagtgcgagagcacgaacttcttcagcatacacaactgatcaaacatttcctggtttgatgtcttagcaaccagatccaacaccagcgggtatgaagcgcacataataagcacgatattcttgtacactagtacgtccgcggtggattgcgccatagcaagaagtagtggcagatattgagcagcaataaacggtctctcagtattcgcaattggagagtccatcgacaccacgtctagaactaactgtgtaaaaaacttggccaaaggcaacttcagcttgctgagattaccgttgtggtacatggatgccgtagtttcgagcaccttgggcagcatctccgttggattgttgtgcatggccagtgtcttggcctgtaacaattgttccatctctgcagatgacattgcgctgcttagtggtagttatatgcttcttgccacgatttaaccatttgttcagtcaagtactaacggttaaaaggtatcgaaatatggcaacttttcacttttagatcaagtcactatatacgacttgaacatcagaacggcgattttccatcaagatggagtggaaaccacgccattataaaggaaagctagttttatgtctcgtatacatgcggagtaggacagtgatataacacacatagctagacacaatagacatcatgaaaaggtccacgttgctgtcgctggacgcattcgctaagaccgaagaggacgtacgagtccgcaccagggccggcgggctgatcactttatcgtgcatcttgaccacgttatttctgctggtgaacgagtggggacagttcaattctgtggtaacaaggccacaattggtggtggaccgtgaccgacacgcaaagctggagcttaatatggatgtgacatttccatcgatgccatgtgacctggtgaatctcgatattatggacgactctggagagatgcaactagacattcttgacgcagggttcacgatgtctaggttgaatagcgagggtcgccccgtgggagatgctactgagttgcatgtgggtgggaacggcgacggaaccgcgccggttaataacgatcctaactattgtgggccatgttacggtgccaaagatcagtcgcagaatgagaatctagcacaggaagagaaggtttgctgccaagactgtgatgcagtgagatcagcatacttggaggcaggctgggcttttttcgacgggaagaatatcgagcagtgtgaaagagagggctatgtcagcaagattaacgagcacttgaatgaaggctgcaggatcaaaggttctgcacaaattaacagaattcaggggaatcttcactttgcccctggaaaaccctaccagaatgcatatggacattttcatgatacttctttgtacgacaagacttcgaatttgaacttcaaccacatcatcaatcatttgagctttgggaagccgatccagtcccacagtaagttgttaggaaacgataagcgccacggcggcgccgtagttgccacttctcccttggacggacgccaggtgttcccggacaggaacacacactttcaccagttctcgtattttgccaagattgtccccaccagatatgagtacttggataatgttgtcattgagaccgcgcagttcagcgccacttttcattcccgacctcttgccggtggaagggacaaggatcatccaaacacacttcacgttaggggtggtatccctggtatgttcgtctttttcgaaatgtctccattgaaagtcatcaataaggaacagcacgggcagacttggtcgggcttcatcttgaattgtatcaccagcattggtggtgtcctagctgtgggcactgtcatggacaagctattctacaaatcacagagatcgatctggggcaagaagagccagtagaggaagagactgtcatagggaagagccctttctacatactactacataatatatatatatagtatagaaattggtatatcactacttgtacaaatatcatattgtacgataatcgcgaagaacgacgcactggtgggaagaagtggaaaacagaagctttaaggtagaaacagaacaagaatgtggctatggtaggatagcagaagagtaccattgctgttatcatttgttgcctagccctatcaagacctgtctgctaatccaacccgagagatcatggcgatccaaacccgttttgcctcgggcacatctttatccgatttgaaaccaaaaccaagtgcaacttccatctccatacccatgcaaaatgtcatgaacaagcctgtcacggaacaggactcactgttccatatatgcgcaaacatccggaaaagactggaggtgttacctcaactcaaaccttttttacaattggcctaccaatcgagcgaggttttgagtgaaaggcaatctcttttgctatcccaaaagcagcatcaggaactgctcaagtccaatggcgctaaccgggacagtagcgacttggcaccaactttaaggtctagctctatctccacagctaccagtctcatgtcgatggaaggtatatcatacacgaattcgaatccctcggccaccccaaatatggaggacactttactgacttttagtatgggtattttgcccattaccatggattgcgaccctgtgacacaactatcacagctgtttcaacaaggtgcgcccctctgtatacttttcaactctgtgaagccgcaatttaaattaccggtaatagcatctgacgatttgaaagtctgtaaaaaatccatttatgactttatattgggctgcaagaaacactttgcatttaacgatgaggagcttttcactatatccgacgtttttgccaactctacttcccagctggtcaaagtgctagaagtagtagaaacgctaatgaattccagccctactattttcccctctaagagtaagacacagcaaatcatgaacgcagaaaaccaacaccgacatcagcctcagcagtcttcgaagaagcataacgagtatgttaaaattatcaaggaattcgttgcaacggaaagaaaatatgttcacgatttggaaattttggataaatatagacagcagttattagacagcaatctaataacgtctgaagagttgtacatgttgttccctaatttgggtgatgctatagattttcaaagaagatttctaatatccttggaaataaatgctttagtagaaccttccaagcaaagaatcggggctcttttcatgcattccaaacatttttttaagttgtatgagccttggtctattggccaaaatgcagccatcgaatttctctcttcaactttgcacaagatgagggttgatgaatcgcagcggttcataattaacaataaactggaattgcaatccttcctttataaacccgtgcaaaggctttgtagatatcccctgttggtcaaagaattgcttgctgaatcgagtgacgataataatacgaaagaacttgaagctgctttagatatttctaaaaatattgcgagaagtatcaacgaaaatcaaagaagaacagaaaatcatcaagtggtgaagaaactttatggtagagtggtcaactggaagggttatagaatttccaagttcggtgagttattatatttcgataaagtgttcatttcaacaacaaatagctcctcggaacctgaaagagaatttgaggtttatctttttgaaaaaatcatcatccttttttcagaggtagtgactaagaaatctgcatcatcactaatccttaagaagaaatcctcaacctcagcatcaatctccgcctcgaacataacggacaacaatggcagccctcaccacagttaccataagaggcatagcaatagtagtagcagtaataatatccatttatcttcgtcttcagcagcggcgataatacattccagtaccaatagtagtgacaacaattccaacaattcatcatcatcctcattattcaagctgtccgctaacgaacctaagctggatctaagaggtcgaattatgataatgaatctgaatcaaatcataccgcaaaacaaccggtcattaaatataacatgggaatccataaaagagcaaggtaatttccttttgaaattcaaaaatgaggaaacaagagataattggtcatcgtgtttacaacagttgattcatgatctgaaaaatgagcagtttaaggcaagacatcactcttcaacatcgacgacttcatcgacagccaaatcatcttcaatgatgtcacccaccacaactatgaatacaccgaatcatcacaacagccgccagacacacgatagtatggcttctttctcaagttctcatatgaaaagggtttcggatgtcctgcctaaacggaggaccacttcatcaagtttcgaaagtgaaattaaatccatttcagaaaatttcaagaactctattccagaatcttccatactcttcaggatatcatataataacaactctaataatacctctagtagcgagatcttcacacttttggtagaaaaagtttggaattttgacgacttgataatggcgatcaattctaaaatttcgaatacacataataacaacatttcaccaatcaccaagatcaaatatcaggacgaagatggggattttgttgtgttaggtagcgatgaagattggaatgttgctaaagaaatgttggcggaaaacaatgagaaattcttgaacattcgtctgtattgataaataaaactagtatacagcaaatactaaataattcaagaaaaaaacattagatagagaggggcagatgttcaagctatacccattatattgatccacacttagtattaagatacgcctatccaggatgaaaaaaaatgtataatgtgactagaggaagtaaggagaaaaaacgatagtaatcgtattttaggttgtgcgtttttataatttttttttttttgtaattctatgcaaatgtaatataagtatatttaaagaaataatgagtcctgtgaaaacaaaaagaaaaaaagatcattaatgtatgttaacgtatttgctttgcaaattttaatttatttgttgttaaatgcattttttttttgtcgtttcagcgagttttcttgaggttgctactatcattaaaatcacaatccacagaggaagttgatctctttttcagttgggtgggggcagagcatgggtgagcagtggccatgggtctaacaggaaataatctttttgaacgcacagataaattttgtaataattttctatttgacattagagatggggtggtgggagttagtgggcttggccaaaagatgcttgaattttgtgggatgctcagtgaccttttaaaagaattttgggtagaagagaacgaacctgaatgtgaatggtgtgatgcagagtctggggtcgtcattgaacttgaagtcttgtaaggggaattgaatggagatggagaggatgaagatgaggttggagtgaaggcaaatggtggagaaatgctatctttggtcaaccttcttaaatgagtgtgatccgagaaatagtctgtggccgcagatgaaaccgtagcgctctttggagtagtagcatttgagtaaacacaagtcaatgaatcgctgtcaaaggactgagcaaagatagtattgtacatggtttccaattcttgtgaacggtagaattcttccagtttcaattgaatacaatagttttgtaatgcgtctaagagagattttgctaaagatgtcttattgctattcaaatattttgatttgaaactggaggggaaagaattttggtccattgctatatccaataaagtattagagatttctgacaatttaatatctaggtcttggcagttttcctccaaagccagattgatattttcccaaaggtttgaattatagtagttcaaagataatttgatgaggttaattgcacccagcgcaattagtgaacgatcatatttaaatgataattcgagattgaaggaagctaactcgcacaacataatggcacccaatttgatctcgttgatgttcaaagaggggccttgagaagaggacgatttattaatagcagtaccagcagcgttatttaataaggccagtttctgttgaatgaaagcttccaaaggggcagaaaggacaacgccaggcgataacggggacgtagattggaacaagaagatgtcgatgtaggagtcgaatgttgccgactgacagatggaccaatcgagtgatttgaaaagatgcatttccatagtcgtgaattgctttatagaatattgattgcaacacaagttttgcaagactttcaaagtggccattctattcttggagtcccaaaatttggacgaaatccaaagcgcggtcaaggacaagagctggtagttgtaactcttgataatgaaccgcgaggaatacttgtccaagatagtgaaagtaaggaacaaagtcgaggtcgatagattgagtcttgtgtgacagtacatgatgaagtcaaagatcaagaaacgcatcttcggattaacttgtggctgagagttgaagttagtcaggttgtacagcggcctttctgtgtgggaaagacggaaatagtggtccaattgatcattattgtattcgctgatcgctgagtgatgtgcttgcaattctcttttaacgagattagggtttttagactttgcactagcaatggcccgcctcttttgcaagagcaagggcaaattaggacatgaggcagcgctgacagaggcggcagtggcggtggaagtgccactagcggtagcataccttgcattagcgtatctaattatggtatccttcaatatggccatcgtacagaaagcgtatcaaatcagtgtcttgaacgagagtaaaagggagatgcaatggaatgtaagaaatgctatgggtcagaaaagaaatgcagaggagttaaaccgaatgaggaaatgcaatggatacgttaaattggagatgtgagattgcgactgggactcggatggatgcttgcttttggatgctagtacagagaaaaaagagggagaaaagaaaagagaaatagaaaaaggttggtttaagtcggcagaggagactactcgggcaattcgtttcctaatgggtatagtcctctttcctcagaaatccatttgactggcagactcagtagtagaagaaaaaatcaagaaagaaattgtgtgaaagtatactacacaagaaaatgtttaagaagaagattaaaagctcgaggaaagtacagatatacaaattataaataggtaggaggaagaaaaaaaaaagatgagggcaaaaacccaaggccaaatatggaaatgtggcagagggacacactaatccgatagtaaatttatgtaacttgatcattacagtgagagcaggcttggtaatttctttttcttgcctgataatttttcactttttctttttttttttcttgaaagttcacaatttagggtttgagcacagcgtttggttgcgacacttccccagaaggaaaaccggcctctttggctggggagggaagaagggggaggagagctcagaaagccctatcgcgatatgagggaccgatctgtatcagcatactttcggtatcatcacggtcgcaggatagagatagtgaatgagttagctgttttacaggccaagcgttcaaacgagacgaatggcgacatttgcccgtcaagaaaacccgccgagttttttcctaaacgggtaaaacagccatgcaccgcagcacgtcgacgaggtgatatttccaatttgggaaatttcccaaatcagtaatgtagcctctacgggtgtctctgtcagccccgtggtcgccagcacagaatgtatcgtacccctgaaggtagttttttaccgccgtggcacagataaaggtgcaccttgtgataataaggtggaaaaatatatatgaaaaagtgaaattgattgtggctgcactaggacatcattatttcttacttggctatttacacgtacttacgctggctgtatatcatttaaggggcggaggacgaagaggacggacccgagatcatccggtccaagaaacgggtcatccggtccttagcattgtctagactatctagggcaggacggacatccacgtggaaagtaggcattccgttttcgtcgtcgggccctccgtagaaatccaagacgtatctaacttccttgaaggttggaggttgttgttccgctttgcgctcgcctcggagtacaatccagtcgtgcctgtcgaatggtagttcttggctaaaatgggacggaaacagtaggccgcacaggtgcatccagcgagcacgagggctcaatacgcccggtttccccatgaatttcagcaacttaggctgcacgtggctttcatctgtgtgcggtttttcccattcgagcacttcctgccagcacccttcatttagaaagttgtggacctgcaccatggactccactgcatcttcggcgacttcgccgctaccgccaatcttgccctttctaaccatagcattgtacatctgttgtggagaaggatactcccagaactcgttactgtctggactcttggggatgctggagatggtccgatcaacgggcaagtccatcttttggccaggctgtttggatgctgccaactccggcatattgttcagcgggtttattctatcgttatctccctgcataacggggcactcagaggatggtggcgacgacgacgacgactcgtgcatgactgggcaccctgacatggatgatactgctgccccaccaatatctttgcccgtagttttttgatctgcccaaaaccaacccattttttgtagtttctgttgtatttgctctgctttattcgtgctactcgtatgtgtatgctatcttattagctgcctatttcatttctcttagtattcgcatttaaagctgagaaattttttgataatcatttcccgatgaaaagaaaaaagggaaaaagtcgataaaaagaggtaagcgaaaagaaaaagaaaaaatagaaaatttgggtggggggggcggaagatcccacgccgcgcaagagatatttcaatattactactacatagtatatgcggcgctaccatacgtacaacttttttttctttttttttttttttgccttctaaatttgtaattcggtcacacttttgtcgcagtgttgcaaacgtcttgaaagaattgtaggtgttgtaaaccacaacttgctcccttgaaagcgttgctgattatttcctttgaacctgttgcattgttgtattgttgtattgctgctgatgttttaggcacttagtattagatattcctaagcctccctcaccataaattacctttattacttgcatgactattattagcagagcattgtagtatgggactcaagaccgatatgatacacaccaaagacgtaggcaccggcgattaaatcaaaggctccgatagccgaaaagtgagaagaaaaaaaaaggaaaaaaaggaattgtcctaatgagcggtgtggccgacttgccataatatcagttagggctactatcaatgttttatctacgttggagtaagatcgtttatcacttccatatttggaccaaatgaaaagttcaatcggccaagtatttcatggatggaatgacgtttggtaaggaagtgctttttctttttccacatattttccctttctctcggggaaattttgtttctaaacataaaaaataaagcaacagcaaaaaagagggtctgtccagcgaataagaagaaaacctccttttcggcttttgaagataggttgcagttgtctgcgggcacaaaatgggcaatttttttaatactttttacgtatgagacaagatttttttcgccaattatatcgcatgaagaataaccagagtttttctccgaacgttaagggagttgaagtaaaaataaagaaaggaccaaatgagaatgggtatgcttggtcttagtcttcgaatcaaattctgcttccctgttcatggcaccgtcacctcaattatttggaaagggggggttttccgactttatttgagatgacttgagatgtgtgtcaatgctagtattttggagattaatctcagtacaaaacaatattaaaaagaggtgaattatttttgccccccttattttttttttgttagaattgatccaaatgtaaataaacaatcacaaggaaaaaaaaaaaaaaaaaaaaaatagccgccatgaccccggatcgtcggcttgtgatacggtcagggtagcgccctggtcaaacttcagaactaaaaaaataactaaggaagaaaaaaatagctaatttttccggcagaaagattttcgctacccgaaagtttttccggcaagctaaatggaaaaaggaaagattattgaaagagaaagaaagaaaaaaaaaaaatgtacacccagacatcgggcttccataatttcggctctattgttttccatctctcgcaacggcgggattcctctataggcgtgtgatgtctgtatctgttacttaatccagaaactggcacttgacccaactctgccacgtgggtcgttttgccatcgacagattgggagattttcatagtagaattcagcatgatagctacgtaaatgtgttccgcaccgtcacaaagtgttttctactgttctttcttctttcgttcattcagttgagttgagtgagtgctttgttcaatggatcttagctaaaatgcatattttttctcttggtaaatgaatgcttgtgatgtcttccaagtgatttcctttccttcccatatgatgctaggtacctttagtgtcttcctaaaaaaaaaaaaaggctcgccactcaaaacgatattcgttggcttttttttctgaattataaatactctttggtaacttttcatttccaagaacctcttttttccagttatatcatggtcccctttcaaagttattctctactctttttcatattcattctttttcatcctttggttttttattcttaacttgtttattattctctcttgtttctatttacaagacaccaatcaaaacaaataaaacatcatcacaatgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaaaaaaagaatcatgattgaatgaagatattatttttttgaattatattttttaaattttatataaagacatggtttttcttttcaactcaaataaagatttataagttacttaaataacatacattttataaggtattctataaaaagataacttatgttattgttaacctttttgtctccaattgtcgtcataacgatgaggtgttcgatttttggaaacgagattgacatagagtcaaaatttgctaaatttgatccctcccatcgcaagataatcttccctcaaggttatcatgattatcaggatggcgaaaggatacgctaaaaattcaataaaaaattcaatataattttcgtttcccaagaactaacttggaaggttatacatgggtacataaatgcagatgccagtgaactatgttcagcttctggccttcgtttggtggtttaatctattttttataaaaaatgacgcgggcagattcaattagtgtcctaaatttattcgcgtttcaagatttcaaaggattgatcctcttatcagaaacgataagtgctactccgtcctattcttctagccatctagtacgtattcttttcataacataatcccttatttacagaatgtgtttcgaagaaaaattaattagatgggaagaaaactgaagtggcttatataatcagtgacatagtgccaataattacgcaaaaagcaaaggaaataacactgctatggatatggaaatcgaagattcaagccccatagatgacctgaagttacaaaaactggataccaatgtttattttggaccctgtgagatattgacacaacctattcttttgcaatatgaaaatattaagttcatcattggtgtcaatctaagtactgaaaagatagcgtcgttttatacccagtatttcaggaactctaattcggtagtcgtgaatctttgctcaccaactacagcagcagtagcaacaaagaaggccgcaattgatttgtatatacgaaacaatacaatactactacagaaattcgttggacagtacttgcagatgggcaaaaagataaaaacatctttaacacaggcacaaaccgatacaatccaatcactgccccagttttgtaattcgaatgtcctcagtggtgagcccttggtacagtaccaggcattcaacgatctgttggcactctttaagtcatttagtcattttggaaatatcttggttatatcatcacattcctatgattgcgcacttctcaaatttcttatttccagggtgatgacctactatccactagtgaccatccaggattctttgcaatatatgaaagcaaccctgaacatatccatcagtacatccgatgagttcgatatctgatgataagaattgttggattttggccaaacccagaaattctaaaacgtaggcagacgagctcagtcaagaggagattgtcaatttaccagaaaactctacgatcgataacagaatgcttatgggtaccacaaagcgaggtcgcttttgaagtgccctcggtagcataacatttttaattattacgactgttttttttattcattatgtagagataattaatgttatagatgctctatactcaaacggtggaagaaaaacagcgaaaaaaaataaccgatacccccttttcgaatacaatgctgtatattcaattatgaattattttttttttttttcatttcttatattattttttgttcgagaatcactttttcaagatggtaacaacatcttcgtcttccaaaatgtgactcaaccccacgtattgaggttgatgtttgacactgctaccgtaaaccagagcatttctaaagtcgtccactaaagatttatgaatttggttacaaaaatccttgacactgcaacggtctgatcttagcaccacagggtcggtaaaatctggtatttggccctttggtttagtgtaaatacggactagatttagtctatcccacatgacttgcaacagctcgtccaagttccaatcttgaccagacgaaataggcacggcattaggaattcggtaaagtaattccaattcctctattgacagagaatcaatcttgtttaacacatagatggcaggcatgtatcttcttgacgaagcttccaaaacatcaatcaaatcatccacagtggcatcacacctgaaggcaatctcagcgctatttattctgtactcgctcataacggctctgatttcgtcattccccagatgggtcaatgggactgtgtttgtgatggaaataccacctttctctttttttttgatcaagatatctggcggagttttattcagacgaatccccacaccttccagttccttctcaatgatttgcttatgatgcaagggtttgttcacatctaggatgataaataacaggttacaggttcttgccacggcaataacttgcttacctctacctctaccatccttagcaccatcgataataccaggtaaatccaacatttggatcttggcacctttataacgaatgacaccggggacggtaaccagggtggtaaactcgtactcagctgcttcagactcagtaccagtcaacttggacagtaatgtagatttccccaccgacgggaacccgacaaaccccacactggccacaccagttctagccacatcaaaaccaataccagcaccaccaccgctgccggatgaagcactggtcaacaattctcttctcagtttggccagcttggccttcagttgacccaaatggaaagatgtggccttgttcttttgggtacgggccatttcatcttcgatagctttgattttttcaactgtagtagacattttgctcaatcaacaactctacgcttgcacctactgcatctagcttcaaacacttcctatcattgcgccctcatcacaccgtaatatcccatcttaaaagtggaaaactcttatagctcatcgatgaaaaaaacaggccctcgtcgcttgtgatgtgaaaaaatttttcaagctttaagcccattgaaagcaagagatcttgcactagaataagtggcaaaggtgaactttgaggggataagaagggcaatcaggaacatcagataagtgaaagatggcgaaaaagagtaaaaagaaccaacagaactactgggatgaggaattcgaagaagacgccgcccagaacgaagaaatcagtgccacgccaactccaaatccagaaagcagcgcaggtgcagatgacacttccagagaagcaagtgcaagtgctgaaggtgctgaggccattgaaggcgacttcatgtctactttgaagcaatcgaagaagaagcaagaaaagaaggttattgaagagaagaaggatggtaagcctatactaaagtccaagaaggaaaaggagaaggaaaaaaaggaaaaggagaagcagaagaagaaagaacaagctgccaggaagaaggcccaacagcaagctcaaaaggagaagaacaaggagttgaacaagcaaaatgttgaaaaagctgctgctgagaaggctgctgctgagaaatcccaaaaatctaaaggtgaaagtgataaaccaagtgctagtgctaagaagccagccaagaaagtactgccggtttggctgctttgagacgtcattagaattgaagaacaacttgaagaacaagaaaagttggaaagagaggaagaagaaagattggagaaagaagaggaggaaagattggccaacgaagaaaaaaatgaaggaagaagctaaagcagctaaaaaggaaaaggagaaggcaaagcgtgaaaaacgaaaggctgaaggtaagctattgaccagaaagcaaaaagaagaaaagaaattattggaaagaagacgtgccgctttattgtcttccggtaacgtcaaagttgccggtgtggccaagaaggatggagaagaaaacaaaccaaagaaggttgtttacagcaagaagaagaagagaacaacccaggaaaactcctccgaagccattaaatctgactctaagaaagactcggaagttgtacctgatgacgaactcaaagaatccgaagatgttttgattgatgattgggaaaatttggctcttggtgatgatgacgaggagggaaccaacgaagaaacgcaagaatccaccgcaagccatgaaaatgaagaccaaaatcaaggcgaagaagaagaagaaggagaagaagaagaagaagaagaagaagaaagagcacatgtgcatgaagttgccaaaagcacaccagcagctacaccagcagctactccaactccatccagcgcttctccaaacaaaaaagatcttcgttccccaatttgttgtattttgggtcatgtcgataccggtaagactaaattgttagacaaaatcagacaaaccaacgttcaaggtggtgaagctggtggcatcacccaacagattggtgccacttatttcccatcgacgctattaaggcaaaaactaaagttatggatgaatatgaaaaacaaacttttgatgtccaggcttttggttattgataccccaggtcacgaatccttctctaacttacgttcaagaggttcttcattgtgtaacatcgcaattttggttattgacattatgcatggtttggaacaacagactattgaatctatcaaactgttaagagatagaaaggctccatttgtcgttgccctaaacaaaattgatagattatatgactggaaagccattccaaacaattcattcagagactcctttgcaaagcaatcaagagctgttcaagaggaatttcaatctaggtattctaagattcaattggaattagctgaacaaggtttgaattcggaattgtatttccaaaacaaaaatatgtctaagtatgtctccattgtcccaacatctgccgtcaccggtgagggtgttccagatttattgtggttgctattagaattgacccaaaagaggatgtccaaacaattgatgtacttgtctcacgtggaagcaaccattttggaagtgaaagtcgtacaaggttttggtaccacaattgatgttatcttgtccaacggttacttgagagaaggtgaccgtattgtactgtgtggtatgaatggtccaattgtaacgaatatcagagcattactaacaccacaaccattacgtgaactacgtttgaaatctgaatatgtccaccacaaagaagtcaaggctgctttaggtgtcaagattgccgctaatgatttagaaaaagccgtttctggttctaggctgcatgttgtcggtcctgaagatgacgaagatgaattgatggacgacgttatggatgatttgactggtttgttggactccgttgacacaactggtaaaggtgttgtggtccaagcatccaccttgggttctttggaagctttgttggatttcttgaaagacatgaaaatccctgtgatgtctatcgggttaggtccagtgtacaagcgtgatgttatgaaagcctccactatgttggaaaaggctccagagtatgccgtgatgttatgttttgatgttaaagtggataaggaagctgaacaatacgctgaacaagaaggaattaagatctttaatgcagacgtcatctatcatttatttgattcatttacagcataccaagaaaagttattggaagaacgtcgtaaagatttcctagattacgctattttcccatgtgtcttacaaaccttacaaattattaacaaacgtggtccaatgattattggtgtagacgttctggaaggtactctacgtgtgggaactcctatttgcgctgtgaaaaccgaccctactacaaaggaaagacaaactttgatattaggtaaagtcatctctttagaaatcaaccatcaacctgtccaagaagtaaagaagggccaaaccgctgctggtgttgccgtccgtctagaagatccctccggtcaacaacctatctggggtcgtcatgttgacgagaatgatacattatactccttggtttcaagaacatctattgacactttgaaggataaagcttttagggaccaagttgctagatccgattggctgctattgaagaagctgaaggtcgttttcggcatcgaatgagcatggcatacgctgacttgtcaacccaatcacattctacaaaatttaatgaattaaataggtaattgtatataaaaatgtgaacctttgtgtattagtttcaattctatcttacttttcattgccattttacttctttcaccttgctgtctttcaaccttggaaatttttatagtacgcgtaaacaaaaaaggtaaataagaggcattgaatataagttggcatttattaggaagttgagtaataacacgttgaaactgggttaagacgatcaaaacaaccatgttgctcccactatgagatccacctcaatattgacagagcatttgggatatccgcccatctcgcttgttggatgatatcattaatgctgtaaatgaaattatgtacaagtgcactgctgccatggaaaaatatctgctatccaaagcaaaacggcgaggaagattatggagaagagatcaaaagtggagttgctaagttggaatcacttttggaaaactccgtggataagaattttgacaaactagaactatatgttttgaggaacgtccttcgaatccctgaagagtatttggacgccatgtttttagattggagaaccaaaaggatctggtcattgtagatgagaatgagttgaagaaaagtgaggagaaacttcgagagaaagtgaacgacgtggagttagcgttcaaaaagaatgaaatgctattgaaaagagttacaaaagtgaaaagactgttgtttacgataagaggattcaaacaaaagctaaacgagttactgaaatgcaaagacgatgtacaattgcagaaaattttggagtcgttaaaacctatagatgacacaatgactctactgactgattcattacgtaaactatatgttgatagtgaaagtaccagttcaacagaggaggtagaggcactactgcagagattgaagaccaacgggaagcaaaataataaggatttcagaacacgatatatcgatataaggacgaataatgtcctacgaaaattggggctactaggtgataaagaggacgaaaaacagtctgccaagccggatgcgaggacgcaagcaggggatatagttagtatagatattgaagagcctcaattggatttacttgatgatgtgttataatataaagtgggaaaaagtatgtgctatgatatgatgtatgtattcacgaatgtattatgtagaaaaatgctaaaaaattggataaaagaaaaccatgtttaaaatgcataccaccatgtgtattataagtacttcgtaaaattcgaatcctgtagccagccaaccttctcgaaagcttggaatagtcttgatgctttattaacgtcgatcctacaggctttttgggcgtcggtccttctaaacggcaaccctttctttgatctataaacttttccaaaaataaccttctcttagaatccagatacaaatcacaaggtaaccttagagtttgagcgagaactagttcagcagggtgtagctcgttcctcagcgggtctgtggacaggtccattggagaccccttccactcgatcttgagtgacttgttactgtctgtaggaagcgtagataagggcggagagtaatctggtaattttttccatgagacgtttggtatatattgaggagcatcatgaatcgcctcaatggatgcaatgttagtgtgaggagtggatgcagagggtgagaacttcttggcgcgatgtggactggtagtcatgcttcttctttgtggtgagtataccttgcgtttccgtggtatccattcagtgtcggattcaaactttcctagattgttattgtagagagcctgtttcctcatattatatcttgcttgtctattcaaattcggagatgctaacggggaaggtaatctagaagaagaggaaggcagaggaggaggagtcatatcatcattgtatttggaatatttatgtctagcattataggccagattgttgtaccggttgataatgttcttagaatatggttgggccaaattgctgaaaattttgtattgagacagaaacccgtaggtggcgtagcggtacctttttcttgataacccattgggccatacaggcttcacgaacagcacattctctacagcgcctttaggcgtagatcccactagcactgaagaggccatgcggggtgagccattgtggctaattttcgactccagcttgggcgacaaaggtggcgatggtattatatgttcatcaaccaaggagtcaatgctgccagaaaagcatccatttccattattttgtgagttctggttaattcttacgtcgtacgagcgcccatagggtgaattattgctataatcactcatgtttaaaccgtttttattactatcgttattgttgttacttgctttcaaattctgattcagacgtctgaaaatggactgcgaatcatccttaccaatgtaattcatatttaattgagacttttcagattcaggagaatataatcccatgtttcccctataaatgttacgatgcgcgaatatcctgtttatcgatgcccagtgtatgagccataacggggatgttatgaaccatgtggctacttttataagcggttctcttaggaagaagggggttcttgatagacccctgcacctcatctagcggaggtgcacggatgtaccaacagttttagtgaacattattcactaaagaagcattgggcatactcagagccaatggcaagctcgtttaccagttcaaatatgtcgtttcattatctgtatgactgtcgtaactttgaatcgacctaatgtgttgaccctgtctcaggctcacccatgcggcgcctgcacctgtgggtgaaggaagaaagacgatgtttgtgagggaactgaattgggttgaagttcatatcctaaacaaacacttcaccagccatggatgcatgccttgtcttttcgcagttggtggcatgaaaatatatatcacccaccaaaccctcttactcttttcttaccaagtaactccagtaagtgctcgtttttttcttcttccattcaaacctgcttaaaaacctcgacaaacgagcccccaacgtactaccacagcaaccactctggtttttctatcttgttgtctttaattgcctcctgactttgttttgttttgttcttgcttagcgctcttgaaaaatattttacttttcactatcagattaatgtgatagcaatagttagtgcaacaaagaaacaagtcgataaatggtacgtttaaaaagtagatatatcctttttgaaattatattcccacctacagacaccaacgttgaggaatctgtgtcgaaagcagacatcttgctttcgcatcacagagcatcgcctgcggatgtgtccataaagtcgatactccaagagatacgacgctcgctgtcgttgaatctgggcgactatgggtctgcaaaatgtaactctctcttgcagttgaaatacttttcaaataagacgtctacggggataatccgatgccatcgagaggattgcgaccttgttatcatggcattgatgttgatgtcgaaaattggcgacgtcgatggactgatcgtgaaccccgtcaaggtaagtgggaccatcaagaaaatagagcagtttgctatgagaaggaattctaaaattctgaacataatcaagtgtagtcaatcatcacacctcagcgataatgactttattatcaatgatttcaagaaaattggaagggaaaacgaaaacgaaaacgaggacgattagaatatattaatatatagatgtacacgtatatgcagtagttttatttttttatctataatacaactcaagcacaagaatgctttgttttcctagtgctcatcctgggcctaggcgccatagttatccgatttatcatcggattcagctttagtaaactgaatggggccgtgagaaccactggcaccttcactcttaacattgaccgcttcgtccagcttttcgtagttggtcttgtatatgctttcaatatcttgttggacgaacagtgggttgtcataaacctggtcttcatgccttttggcggaggcatttgccctcttgtgaaaaatcttgaatcgtactgcagatccggttgttctgaacgctttgctgcgcccagaattatcttttcggatacgtctcttccttgagagtacgccagctcttttagtctggccactgtgctcgtttgctttttgggcttaactattgctcccgtctgcggagtcccgttgtggtatctggctcgttggctcaattctttcaatttagattctttagcaagcatttcctgttccatagcaagccgcttcaattccattttggacctgatctcttgtcttgccttcttgtcagcgttttctaacgcttcggagagcttcataaacccatcgttgatggtattattttcgttgtcaagagctttacctacacgtctttccaaggccacggtataaccatttggatttttccagtttgacacagctgcaggtatcttccactcatttggatcagcttctcccctatcattgctgccatccatatggagaacaggcacgacttcgtcgttttctgtgggtgctacaacctttctcgccttcttcccaacgaaccttggcaacaatggatccatttgcttggacactacctcaatatggtggctgttgttcaataatagattcgcgggtgcctgatgtgtttcggtgacgtaccttgatgatgccctgttatttgagttggctagtttcgcattcacaagccgctgaatgtatgacttggttcttgctgtacattcttggatttctgctttcgttggcaaaggaaccgatagttcgaaattagactgtctctttggaataaaatcatcgagcttaacgtttttagcgatttggtcagtcaatattgccggctcaacgcgatctgagctcaaagccgtcgaaactcgtccttgagaatgttttggaggtggtagtctgttactaaacatatttggttgaggttgctgatacgtcctctcggctcagagctgccatgtgtcaataaccccataatttgaacttctttcatcaactttttagctggggaaaaatcaaattcgtgaagaattacaataatacgttaaggtaaaagattaaatattaaaaaatagtatgagtacttttgaatcatcagacaagaacaatgaaggatatgaatagtattagatatgtattcttttttttttccagggacataaagagttgtttttataaggtgcggagttatctcaatttgcttctgattttagaagctattctatgcccggtcgactctttgatttcgatcccaaacggcatcatggtagtttcggagccagattcgccattttcccactctaatccatctcgaagactttttcgaaaggtaaacccttcttcttgtctcagcgtgttatatttggacttatgctgtagcggcttgatcattgccgaagcaggtattggcggataatgtagcacagccggcttcttgtaccaacccacctttgttggtttaggattttctgcctctgtcattggcggtacaccagcaaatctcacccttttgatggacaattcactggagtttgactccggatctagagttaatgtctctatagccaaagtatcactactattggcaatcagggtacttgatgattttcctgaggaggtgttgtttatactggatacttttggtgaaggcgctaacgatgaagatgcagaaggattgggtgtagatgcacttttgttcatcaaatgccgcactgtatcttggacgattttttgatttaacgtcatggttgaggactgcaaagaattggacctttgattgttgagctttgaaggtggagctattgacggatgtcttgtagaattcaaatatgaggtttgttgtttgtttgtataggattgcaaagatgaggatctaggccttctgccgttgatcagttttcttttctccggagacaccacgcttttcttcgtttctgcgtttttattgttgaaagtggtccttacaggcgatactgagggagacctagaagaatttgaggctaaatgcgcccttgcccttgttcttatgctctctaaagaggcctgtcttgatgggcttgctgaagatgtgggtgagggggatggagaagaagaggctggcagctttgttattgacggcttcttctttagcttacttttcgcgtttttaacctctaaatacagagccttatctctttctagcttttctttcaaattctcccgcaagtcattggtttcatcgaaggttttataatttttctcaatatatttccagcaatccatccaattggataataatcccataatggacctcaatttcggtataatcttgcagatatgattattaaacaattccacaactaaaccaggttgaaggtggaaaatgggagttcttgaggaattgttatcggtacgcgccgtttgagtccaaaattttaaattctcctgcagttcgaataaagctgtgacatcatcacattctggagagagcaaagccatcagctcacaaattatcaaatcgtaatggtacacgttttcgctggataatcttgtcttgatgtccaagaaatgttgtttattcggtaggaaaatttgcctagagaaactgataataacacacaagacagaaaaaacccgcaagtggaaagtgtatatcctgtgtagagtccattcccaatgtggtagatccttctgtaaatttgacagtgaagtaggtcttgtttccgaaaatttctgcaattggttgtaatatgtccttagaatggggaagattttcgaatgaacacaggagttcagtttctccatcacttgccattgcaatttgtaaaaggaatgggtggacttatcccttactggatcattaatcaaaacggctaaatctagaatcaatgtcatttcaactggatttaacaagtcttcaattattgaagtgtcaaatggaagtgaccgagctttgtacgcatccctttccaataaaatctgtctcaacttggcattataaatttttatagcattttgagcaatgcaagacagcgaatttaaaatcttccattgtagagaattattgtatatgcacgatttatagtgatctaggggtacctcctcgggaaacatccagccctctacatcaataaaattagttgataatctctgctgcacttcgcttagctttatcagctggaatcgacagagcaaatggtaccttcttagccaatacggggcttacattaaatataggaccctcacaaagtgataagatgaaattaacgaggggaataattttgtaggactcgtcattgtctcttttcttcttcaaatgcggtaccagaacgtttagtagcctattcagttcattcagcttgtaaagagcgttcttatattgaatgatttttatatcatacgagtccaacggaacagaacctttgattgccggaatagaagcgctggcagcagctttggctagcaacttttttctcttttgcacatctaccatgttgtaatataaaactagtctaaatcctcaaccttcagcttccaatcactccttttatcattgttcattcgctaacaaacttcaaacatatgcctttattatgcgtcttcctgctgtttcaaccattgattgcagggtaacagacatttttaagggtctttcccacagcatctataagaaagatcgtcaaaagtattagttaaacattgaaaatttgcgccaaagacatagcaagcgcaacgtattcattgtccatgtcgtcatctactccctttgacccttatgctctatccgagcacgatgaagaacgaccccagaatgtacagtctaagtcaaggactgcggaactacaagctgtaagtacagaaagccacagagtaccatctaggaaattaacattatactaactttctacatcgttgatacttatgcgtatacattcatatacgttcttcgtgtttatttttaggaaattgatgataccgtgggaataatgagagataacataaataaagtagcagaaagaggtgaaagattaacgtccattgaagataaagccgataacctagcggtctcagcccaaggctttaagaggggtgccaatagggtcagaaaagccatgtggtacaaggatctaaaaatgaagatgtgtctggctttagtaatcatcatattgcttgttgtaatcatcgtccccattgctgttcactttagtcgatagaagttcactcgcaatgctatatatatagggagcttccatatgtagtgtaggatatatgtatatatacatatatacatatatgggcgtatatttactttgttcttattttctgtctaattttataattttactgacagtagctaagccctctgtattgctgttctgtgttattgcactagtgtcataacgcagatggtttttagcagagtcaaattgggcagaaagcataatttccatcttccctggcaaagacagattttctcttttgatcacgttagctaaataattcaagatttcgttcggtactccagcttcgcccttgttagcaggcttgtatttcaacagaattgcttgtatttgggctggattcaaggcataccagaaatcgaatagtaacttgaactcgttcaagttgcttatcttcaactgtaatatcttgacagcctgaattatttgaatcaaattgggacgaacgtcttcaattcttggttcaaaccagctcaccaaccgctcgatatttctatccacttcgtacccatacttccaatttaacgcgggacatttggttattaggtcattaaatagcattacgttcagatacttcagggtgtcgttaaaaatttttgtatgcattgagtcaacaacttgaaatttacacaagacagcatcaaattcatttaagaatgtgaataatttagcgaacttctcatcaccagaatttttaaatagcttctcgtttaaaaccatatcgaagatctcgatgtgggctgaagcatgcttcatgaatttcactaaccaagtggaataaatcttgtcgaatacttttaaagtttcattctccaaatcattcaaatatatcagtgttaacttatctttttcatcaccaccattcgcttcatataatgttttttgatttgcagcaaatgcgggaagtctggaaagattacttaaccaaaagataccaccaagcattgtttcgtcctttggtagactcataacaatgctttctacagtcaataggactttcgagatgaatttgctactttgaatcaataacccatttctcactaagctacttaccactgtagtaatgacgtgtataggacccagaacattgtctccattcacctcagtaacatttacttttttcaagtaaccttctgtgacttctaatgtgtaacaattcaggtccattagtaattctagaagatcaggatttcctgattctctacgaattacattgactagcttcggttttacttgttgtcctgcgattcccaaacctttcactttatcattcttattagcagaatatgtggtggtgaaatcttgtgctattacgttttcaataaacgctagttcttgcttcattgatttgacttcatcacttaatcttgaaggtttgttaccttttatagcagccaaactttgcatatgtgactgtattaaagaagattgcttcttttttctctccttcaaggcattcttcttgtttaaagtattcatgatttcaacttgtaacgtcttcagcttggaaatcttatcattataaccatttactatcgtttcgtactcttgcctttgcttagatggaatatttgacaaatctccctgcaacaactgtgttaatcttgtatatgagtcatttaacatctctagattcaaaatgaaagagttcttaaattcgatagcttcctccagtaatccaatcccgtaactagccctaatattccgttcttcaacttctttttgcagaactatataccttcgtctagctaactgcattctcatggcgctttgtacaagaatggagctccttttcaatgttctgtaatctgttttgtgaccatatgatctgatgtagctttggataattactgccgccatgagcatgaatttcctgttaacactatctaaaatcaattttcttttacaggtacattgtagttttattatttgcccaatggcagctctatagtattcccgtttccataatgctctaatgttcgtttgtagtaatatggcagctcttgtcttgagctcatgatcgacccttgtacgaaccaacaaacttctaatttggctttggcacttctttattgattccatggtctgcaaatactgaagcctatagtatcttgcccttatctttttctgtattatgatgcatatttcattcattttattagtccttagcttttccaaaaatgcaagcattcctgctttaaagaaaattttggtattaccaatttggtattttgctgaatcagagatagtagcatctagaatagattgacagaagttgacgattgcctcttttgggaggtctggattataaagaattccactccataagctgtagtccgtcaggaggaaatatctttgaacgaattcgtcaaaagtccatcttgatggaaagcctgcacatgaaatcctgattgtttccagcacaccacaagctcttaattgcgataagaccatcaaattatcgaactcccatggctttttttcagaatttggttttatgcaacgaatataatgaacattagtagaatttatgatggccatcaattccccgagcgattttttgaacatagatcccagggttggtttcttttgacttaatcttgctgggatcattatctttttttcagtattttgctcttcaggagcatcgtcactcctaagttctctgttgtctaaaatttgtttgaaaattggatttgtcgttgctttgaaaacatccagatgacctagggaaacgctgtctctattcttttcaataaacccttcaacttcatattctacatcaacagcataatggcttactataaacttcgtttgtccgaatcttggcttcgaaaaaacttcatttgagggcggtttattaaaggcagaatatagttttgaggcccatgattcatctgagcctgatggtaatctactttcttcatctaatagagaaagtattccaagtttattctcaatcaagtctatgcaaggttggttgtcgctgaactcaatgaaagaccactcaatttcctcctttacatattcttcttgctccaatttgaaaacgtgctggttgaactcttgttgtaatttttcattcgcatagtttatacagaattgttcgaatgagtttttctcaaaatgctcaaacccgtagatatctaaaataccaataaaggaaaagacatgatcttgttgatccagctcaggatcgtataatgtcttgttaatgttgtctactagccaatcaaaaagcgtggaataaataaatttcgccacagagtccctagcaattagcgcttgattgtaattcaaattagtgacaattttttcagaccttgtgacgatttgtttcttgacaatccattttgcaaaattgaagggatcaatacccaataattcacatgcgatttgcaggttttgctcttccgatgatagtgatgcgtcgtttctagtcattttcatctcgatattacctatatgtagcaagcctgcaagaattttgaaaattccaagctgagtctcgtggtttatacctactaatgacagggcatcagtggttatcttgtattctcgagcttcatctataccagctatgttcggctgtccaccttggttagtataatggtagtccttgggagatgacaaatgcagttcttgttttaccggttctggcaatccttccaaaatttggtaaaaaatatggtaatttctttctgtctctggctgataaactaacctggatttttccaagagataggttctaattttggaccccctgatggtagtattctcatcaaataaaatttgcagatatttgccgaaacgagaggaattatcatttctggtagttttggcgttaccaaaggcttccatgatcgggttagtagctaaaatttggctctcgatttgagacatttccacttccccttcacgattgttgctttcttggactgaggcaaagtatctcataatgtatttagcagagacggtcttaccagcaccggattcaccactgactacaacagtctggttagccttttcatggaccatgaacctgtacgcctcctctgctatggcaaaaaggtgcggctccagctcatctttacgcttactagaataattctgtatcatctcgcgagagtacaaatggtcgactttatcaaagggattagcggcaataaggacaataccagagtaagtatatatctgtccattcatgtatcttttttttatggcatgcagcactgccggttcgttcagatatgatagggtggttaagtcatcagtagactctaaaataggtgggtttcgtagtacaggtagcgtgggatgatcatcatcattttcgaagctatttgtttcaatggatacagtttctccatcctccaatttcaactctaagtggaacgttccttcaaagaagtcattcttggtgacttcgccgcctatccagccttgttctttgtgagggtaccaacacttagttcctacttcaaatgacatgcgggagaactggttataggattttttttgtttttttgtgttttagaattagattgaattataaaaagaagaacaaaagggtatcgtattgaaaataaattgtctcgccaaactggtaacaatgttttcagctagaacaataagaaaagaagagaaggtaaaaaaaaaggtgataactccgtaggaattgaggaattgagtatgcagaatcagaataaaggctgactttcaaaaaaaggttgtattacaattgcaggttttcgataaaagagaccctattctcatctactactgctaaacttcgagatattttcgaatttttcagtcttttcttttttttttttcgcattagttcagaaccctaaagaatggtaaacattctatggataacccggagagtgagtttcttaaagacctagttttattttaagggttttaactcaatcttgatgttttcattgtgtaccctaaagaaagtttaagaatagccctaactgttaccttttgaaataaaataaggggaaggtcaaaaagctattgttctattgttatgaaacattgtctcaaagagtaagaataacacaaattgatggcagttttttacgtagtccagtagttgtccaggtacaatgcaaaatgctcaaataaagagctcttctaaaggcagcggaatagatggtacagatcctctacgcaaagatggtgtagaaaagagacccctggaagatgtaaagcaaatgattgacgctggaacaccagatgttggccacaaatctactgttgaaactaagccaaacgttggatggcaagcctctcacagtaatttggctgcattacacgaaaaagagcagaaatatgaaatggagcaccatcatgctcgtcataaactgcatcgtcaagttattccggattacacgtctgcctcgaccgcaatgttcagcgattgtatgttcaacgcagcaccagataaagtacgaagtctcagtacgatgaagtcttctggactctcgccaaaacacccatttaacgtagtcgccacctttaaaggaccattcccgcagcatagtgtagaatcaaagcctctcgatggtggatactctgccaagaccattttccctcatttaagatgttgcaagcccagcagcacccagcccatcgccattacaaagacaacgacaagtacggtcttaaatcaccttcccggtccttcgtgaaggacaagaaaaggttggttcaccggtttttgaaatccatggagccttcttcgtctgggcaatctaaggattcgtctgcactggcgccggctttcgatccaatattgcccaatgttatatctaagccttccaagcgacccacacatcattcgcattcatcagacgggagttctagcacgcagacagatatatcgttacagagcttgctttaccatgatcttgaaagctcaccaaagaaacatgtttcgccctcaagaccgccctctgtagcttccgaatcctctcctgccgttgctaatcccattgggctttcgccaaaagacgcctgcaatgcatcgttttcgcagtcgtcctcatcttcgttgtcttcttcttcatcgtcttcatcatcgacgtcattctcacagtcagtggctgttgatcctcttgaacctcctggaaatatcacatatagtagttcgaatctttcgctaaattcagatgaattagactactatcagcgtcatatcggattgcagttacagcagacagaagctttactaaagcacagtttgaaagatgaggttctgaaagatgaaaatgaccttgttaaaaacattgcaaattttgacaagatcgttaaagagctaagggacttaagatccaggaccattggatggaaagagcttgttgaagaggattatttaatgaatttgaaacaggattttgacaaggaaaaccccgaatcatttgaggcacgtttgagtgatacaataaatacaaacgtggcaaaattacaagatttagagaaaagaatggcttcttgcaaagacaggttggcctctaggaaggaagtaatgaggaaaatggaaagtttattgtctttggagaattccttaatgatatccaaaaaaaatgtaacattcgcatctaaataccgcaacgaggcccttgatattgtctttttaattatcatcatcgtcatatgctataccttcaagcatctagtatcgcataaataaaaaatagtatttgtatatcaaaaaatgatcctgtgattttttcatatgtaacgtataaatgtaaaaatgtgcttcttctggtatttttaatcaagtggaaagatgagtggaaaaaagggcaatgaaatagaaaaggacaggcctgaaagggaagaatacaagaagattgagtatattggacttcacagtaaccgtgaaaaatggcaccaagtatagcaacggtaaagatagccagggacatggttttgccattacgtatatttgtcaatagaaagcagatccttcaaaccaatgataagactagcaataagtcgaatgccactatatttgaagcaccattattatcaaataactccataatctgcttaaaatcaccaaatacaagaatatatttatcgcaacaagataagaagaatctttgtgacgagatcaaggaggacctgttattgattgtttacgaactagcgtccccggaaatcatcagttccgtactcagcaaaataagagttggtcattctactgatttccaaatcaacgttctgcccaaactttttgcaggtgccgatacggataatgcggtaacttctcacatccagtctgtgacaaggctggctaaattcaaatacaagttgcactacaaacataagtgggagctcgacatattcatcaacagcattaagaagatcgccaatttaaggcactatttgatgtttcaaacattaacattaaacggtttctcattaaatgcaggacccaaaacgttattagctaggaaaatagaaaaacagccccaggtacctaatttgttaatagaaaatggggacgctgatgccctggatacaccggtggaagaggatataaaacctgtaatagaatttatgtacaagcctgttattaatttaggtgaaattattgatgtacatgtgttgcataggcctagaagacataaggtacgtacccagtcgaagcaaccccaggaggaatgaaaaaccgataacaaagtgttggcttaatattataacttctatataacggatatattttatggtaaatgtacatatttcagtaatggtaataatgacttttctttttatcttatttttatttttgtattttttgtcttctgctctttgtttctgtgcctcatatatcaaatgaaatatcatctctcgaagaactgaatctatttgaattttgattaccatcagcaaatggattttcaatgaacggttctgcactttcaaagtcgttacttcccagtccattattgtcattaaaggggttcgccgaagcatcttgtaattcaccgtacttacctctcttttgagtagtatcatacattctgacaattttttcttgcccaccctcttcagcctgtgaaaaggcaaatcctctttgttttttcattctttgcacttgcctcaccttcctgatggcattttgaaattgctgaacgtgcggcctagagtcgctgatattgtatttctgcatttcttgaataacatgatacgtttctggttcatacattcttttatagtacttccatagaaaatctcttaccagtgcaaaaattggtaaaacgatcaaagttaaccaaaatacaccggatccatacgtgtgtttaaccacaccataatactctcttgagatgttagcatgaggaaatatagaagcataaattgggaagaatattaaccaaaataagagggaaccaggaatggcaattaaggtgaatttcgtccattgattagttaccaaagcagcctttcccaaaacaataatgacacttgtagtgtagacagttacaccccaagaccaatgatcagctagttcgccgtgcatatttaaggcaaacccatatctgtaaatcaatatggtgccaataaatactattgcagaatggaaaaagccattaataatccatccccagaagatgtaaacagagaaaaattgacccttctgtcctaatttgtacaattgtgggtaccgctcaagtaatctactactaacaaattgatcaaatacaccaatgacaaaagggggccaaacagtgaagaataagttgtagaaactcattgtccatgattccataatggattgacctgaaaaggcattggcaaaaacgtaccaaaactgcgtcatgtataatgctgtattcttgtaaaaagagtacaaaattgcgacagaaattctttgataagaccaggagccatggacaagtaatagtttttttaaaaatttaaattggccaagagctatatcagctgaacgagccgcttgcataccttccataccactaataccgacaccaacatgagctgcctgtatcatactaacatcgttggcaccactcgcaatggctagcagtagtgaagacgactttctttttaccattttaacaaccaaggctttctgtagtggagatacacggcaacatataaccgctttacaaagcttcgccacagttagcaaataatcttctaattctggttccaaggcaaagcctaatgacttcccatcaatgacgagcgctaaggatttcatatcatgtgttgacaattgatgctcgtttagagcgttaatcttctctaacaaatttctctcagtatcatctctggtttcctcgttgatgatcaacaaattcatgtcttcactcaataaacggcaactcataccaatgttaatagcagtttcctgtctgtcaccagttaaaacccaaattttaatacccgcttcttgtaatgtgtggatagtttctggaacaccgtcctgtaacttatcttcaatagcagttgcaccaattaatattagatttttctcgattagatttgcggcttcgtctagcttctcggctctgttatctaatgttgtggcagcctcattataaatgctattccattcttcatattctccttcagagatatctctcatcgccaaacacaacgtccgcaaaccctcagatgcataatcttctaaatgtctcattgtagcttctacatattgattagcttcatcatccaatctttccagaatgacagtatcagcacctttacagaataactttatcgaaccatccggaaatctaaatatagcgctcattctcttcctggtggaattaaattcacaaatgttaagtagttgatactctttttcctcgccagtttcctccaataaaacagttacagagtttcctttacggatgataaacttataccctaaatctgcaccaccttgaacgagggcaccttcatctggagaggctgcttgatatttaatagatccatcgctttgaaattctggaatgacagtatgacaggtagccagtaatgttaagaagtcattgataataggtgaatcctcatcagagggatcatttaactttttcttcaaatcgtcaaattttctataaccaacttcaatcccatcttcaacagtggccgttttatcttcaggtattttatcaatatagcaatggcctgcaatagagcaggatttaaattccataatatttcttgttaaagttcctgtcttgtcactgaatatatattctatttgaccaagttcttcaaccaaagaggatgtacgaaccacagttggggtatcagttttttcgtagtacaaatctagatctgaacctatcataaaagcctgataatatttgattaattcaacggtgacaaatagagaaataggaactagattcgaaaatagaatccaaaatgttaaaaagtctttgaagaataagccagccttgttggtaccctccaggtaaaggtacgataaatgtttggcatctgcagtagacataataacattaccaattgaagaaattaaaattagcacgattaaaactgtgaacaatcgaataatctgtctgttgataattttctcaaccgcggttcttttaattggggttgcagtagcattacgcaataacttagtttcatgaccagtgaagataactaaaccaaatatccatgcagtatttcttaaagttgcacctcttaaaatcatttggtcaggagataacggtatttgacgatcatttaaagtcattgtaccttcataagtatacaagctagagttcggctgttcggaaacaacttttccgttcatgttcttcaaagttttaacgtctataaatttggcagtttctactctcgactgtttgattttcaaatttgtttcaccatccaagttggcagtttcaatgtagcaaagaccctccggttccgaagatgacaaaattatggtatcagcaggaataggttcctctgattttactctaattatgtcacctacacgaatatcaatccatcgtttctcaacaaagtcatcatgtgcttctgaaaatatttctgctgtcgaattatttaattctttatcagaattagctctcttgatatcttcgatacattccttcatggcagaaacaatcaaaaccactaataaagtaccaattgtggtgtatctattagttggcgagacgtgaggcacctgttgaatggcagatgtacataaaaaaaacagattagcgtatttggaaaattcttggaacaaaaatttaggcagaaaggtcgcaaaattatacttggtggtagatatatggttgtcactataaccgaaggaggaattagcgagagaatcgttgatgtggatgactcttggttcaccattgccctctgcgtcgccaacgttctttcttaaaatgtaccggttgaaaagaattttaatgttgaacttattcctcgagtctagataattatcgtctaattcgttattagtcaccgcattgtaatgattcatttcgaaactttcgggccctttcttccgtttgaacgtaaaggcatttttgagaccattaccaaacctagcaaataaaccgggaggcttgactgctcgtagggattgtggttgatatgcatctgagtcgaatctattggcattccaagacgtttggtcgtcatggttattgctcataaatagattttcatggacatcattttcaatgttatcatcatcagcgtctaagtcgatagtctcttcgggaagtacatgacttggtggtatataatatccgttcgcatgtgagttggtgacctttgaacgggatccagaatgagaagtcgtgtcgtctaagaagtcaatatcgaaaagcgtgtcgtcctccccaggtttcctctttgggggggtttctctgtcgtcattcatggtaaaatcagggaatgaaagaacctaccagtaaattattgcttggcgctaacctctatttggcgttactggcttcttgttgcactattccccttagaattgccaacaattgttgattatatgtttcttcaacttagtggcaataaacagatttgggttttctggcaaaaaaagccaatcacgtgatcaggaagatttcagtgatttacgcttcaaataacctttacctcaataatcccgtaatagtaagcttctaatagtaagcttctaatttgcaatgttattagcccaacagctactaaaggtattattttttttttttttgataagaaatttaagtgttacagaatgggccatcttacaaaaataatagtctttatgtatttttatatatgtaaaagaattgaaatattttataactggttgttattatggtacagtgcgctgcccaatccacgtggaaaaatcctgttcattcaataatagaaactgaaatcatgtaatgttgcgtagtatagtgcgtgagcttattgtgccacttcttgctcagcattttgaacttcgtgttcctcctcgtattcgatttcgactttaggacgtttagttttggcactagttcccttcttacgtctcttggctgaattcttattttcttcatcactatcgctgtcgctctcgctttcactgtcgctttcgctttgactggcgctggaagcttctctgtcagagtcagctaaccacttttctaagtcatccacgtcaacgtattcaccttcgccatcatctgcaacgtattcaacttccccatcatcactttcctcttcttcatcccagtcttcttcctcgtcctgagaattctcctcttccatttgacccattatcttcttccagaccttttcgtcaacatttaatggtttatcaccgtaagcaccactctttaatctgtccatcaattctttttcgatggctttttcaatcttggcagctaccaatgcctttctctccctgttttgttctcttcttttgacctttggtgctacaccaacgtagtgtctctcctcctcccttaatgctaaacgtctctctgttatcatgacctgcgtcaattttgtaaatctctgtttacacttatgacggaaaaacttgctccaatgtagtaggtgttcgtcgatctgttgtaaagccttcgtgtaatttttggatagtttgattctttcccataacttggcaggagtgtgcgctctttcaggcgtcttcatatacaagtacagtttcccattgtcacacttcactgttgcatacttggagttggcaagtgggcatgattgccttgtacacaacccagtgacgttatactcatttctgcaaaaattttgaccattaggtgccttaattctatgagagcagaaactttgattaatcacttgccaaacaatttcgtcggacatatcctcgttgtattctaaccgttgtagttatgtactgaagagaacactgtcaaaagaaagaactaagcaatgcaatatctgcctctataccaatcactttttcattttttttcaaaagctcatcggaaaatttttcaaaaaaaaaaaaaaaaaaaaaaaaggtttattaccctactgcattttgataatctgaacataatgagctaatgaaagcaattctcatttaaaaacaagtattctctcttattgaagtatgcattatctatcattataaattcttttattctgttcgagtccatgtttttaaaaaaaaaaaaacatgtatgtatgctccatctatatatgctccatctgtatattttatatgcaaagttttttacaagaggaatttgggaactggaggaaagtggcacaatacctcatgtggatagttcattaatctcttcttgtgttaatgtgctaatataaacacacttactcagcaattcgtggttaactttgaaagtgtaaaacttggaccattgaaccctttgaatgaaattcttgactatttgaacgttcgtatcgaatttattgtaattcactactttatcttctaagatccagtctttcttctctgcgtttgctgataggtccgaaagatatacgacgatgaaagggacgcaacccaccagtggattcacagagttaagtagatttcttattgtagaataattcctgtctagcgagggaatcttctttagctcttcccaagtcagtaagtcgcctggttcaatcagacgccatgcatcagtgaatttttgaacaactgaagaacttaaggctagaatgatttccatcaatgtgttaaagttctgaaatgtcctgcagtggtctgcaacgtgtataaacctttgaatgacatttcttttcattttgctgctcttggtaagaagtatttctgatataatccaatccacagttaagttaaatctggatatagctaaatcaatgccagataaggtctcgttccttactagtagttgcaaccaacttataacttgtgggccttcatgcttcatctttaaatctaataaatctttccagtctatttctcctaaaatttccttctctatcaaggtcatttgttgcgctacagacagggaatcgtacattagtataaatggaacgtgactttcattattagaaatcattaatctcgaatcgtgaatcctgtattgaccgattaattcctggatttgcgccgcttgcacagcaacatcaacattagctgacacgtctattttttcaggagaggaggaagtaaagccttccttctcggattgatctggagtaaaggggatattcattatagtttgtctccttctttctattaataacgattttcttttttctgcggggctattttggaatgacggcaagttgttaaggtttagcatttccacttcatctgctaacttgctcgttttaattccaatagcgtcactactcttggtgttctctggtttttcgggaattttctcgtatgtaccttccagtttcattaatgccacggttattggatcgtcattaattgaatcatcgagcatattagcaatttcatttaaatttttcttattcaaggagcctgtaaaagccgactcagagtttgctctccgtgtgttccgggcactagatgtgtcattaatgtcgatatcgtccattgtcaatacacttcctgatatgttactattagtttcactctcgttcttcagaaatttacttttcagctcttcaacgtttttcattggagaagcaacgtcaatgctaccgtcatctggtgaaaaaaaatacttgttgtttttcgcatgggtacttggactttctaggtcattattggaatcgcttaaatcaattgtttttaactcatgcaatgaagaagtatttgagattatatcttgattacccctttgatattcttctctcaaatttattatcctttggtgtggcactggtaaatctctggacgtttcgaaagtttcaactgtgctaccagtggtaatcgaattcaaatcacttacaacagattctattgtgggtgctatggataatctgattctattggtttcactcacgctggtcccgttgggaaattctctctgtggattttgagtttgttttagaggactattctgagcagattcaaaaagcttgctcgttgagatactgataacggtggacgatgtatcagagtacaacgcgctttttttattatattccaggttgagaggttctatttcacttatttcctctataactgagtttgacttgttttgctcaggatctactatggataactctttggttggtgttatggcaatgctttgaactcttgaaatgctgatccttccactagccggtcttacaactgcttgtttgatcttgtgattgcaagatgaatgtttttttcttgtagttatatcataattattggcttctgatgatgcatcgagtgagttgtccagcttttttgtgctctcatattctgattcctgattttctttgttatcataattcttttcaaggccatctatagtactctttttctcatctaaagacttggtatcttcaaatgtaaactctcttagatttaaaaatccagtttttgtttttagagttggactatctgtattattcacgatgtttctgacttttcttgactttttcgttacagtatctctgggtggagagctggatgacaactcggaatcgtatgagtatgttattgattctgtgtcttccctactatcgtttaagggagacgattctttaagatcaggtagaacatttttcagaggcgaagaagtcatgcttttttgggattgggaatgatttttcctccttggtgtcatatttgtaatcgcttctgagttggttttatcagtttcatggaataacaatctttgaggtccattctcgtctgtacgtgaagaactattatctttatcaaagagcctcatactttctgctgagtagctaccgtgcattttattgtaatatgctgtcgtgagactttttactttccttcgttgcagtgcatcatacgagggtgatggctgcatattcgattcattgttctgcagttgcttgtttaaagtattagttaaagagatgactgactgagcaattgaacttacggtttgatacagatccaaattgtccatagcgctaaaattatcattactcggtttaaagctattttgttgtaaaatctttatatcatgtatgtgttcccgacgttcacaatcaacattaactgtaggacctcggttgttattcgaatgtgtttgaactttttctatcagctggttttgtaaatgcagtagggactccacttcatctatggttcttgcacttaggatgtcaaatttagaagaatcagagttaagaaactcttcctcttcttccttggaagattttctattgagagatgatattgatacaacgtatttgacaaacgcatccatttcaggtttctggtttgctggtttaatagcactcataaattttttatcattactgctatcatggcgattatggtttttcatccacttagctaaaagaccaatagcgctgcgatgtaacacagacattgaagatgtattagatctactattactgttgctattgttatctagagatgatgtcgtcgatgtaccttgaagcgttccgctttgttcatttaaatcttcaggaatatataaggaattcagaataaattcaacttttttagccggtgttggaggcattattttatcgactgcatatgatgacgggtagtctacgcctttcattagtgtggatactagagtgacttttgacaagtggctgatcttttgtttactatctgacatgtcctcgctttcattatcaactgaaggttctttcgctattcggtgcttcgagtaaacatttgatgtattatcgggaaataaaagcatagaagggcttctctggtttttggaagaatttgaagactgtagcttctccggcagtctaaatacatcagaagttttatataatgataaaacgctttggttacgaaaatcaggactggcaaaactttgcctggcgtaaatgctcagtcggcttcctcttttgtgtaggctttctagttgcgtgaaatcctttaacgaataatgcagccatgcatcaaagtctaatttatcaggttcatttagttcaatattctcccaaaccaacttagaacaatgcacccagttttttttcagattgattatacagctggaaattatttttgggtactgttcaatgtgtttgtcgtttagaaactcgatcaaccgaagtcttaatgttatgttcggtaaaaaatcttgcacaaaataattcagtatggaatgcctcaacaacacaaacgtcctcacgagggcaacttcaccaattcgccttctcttagcttttgcagcatttgttgtgatctccctaatacaccatcgaaatctatagatgagtaagtcgtgtaagtcttgaggcgttataaaattcctataaataaggaaaaaatctgcagatgcgttgtagtctacaccttccaaaggggaagaaaggtgtacaattaacgcgggcaggtctgcactattcactggtttggatacacaatcgctttcatagctaataacatttgaggatggagtcgggtagtaatctttctggctaaatatttccatggttcagggtagcgaatctttgaatggctagaggctatgtaaagcaaacaaaaaggttcgcgtaaatcaacgagcgaataacacgagtacggttggggtgggctaaagggttcaagaaattatcagtttctgtttacagtttttttttcattgttgataaaaagatcaagaatttcattattcgcgaaaatcaaaatgcagaaaggaaaaaatagaagggtaataaaacagcatcggatcgcaaagatgagtaaggagaacagcctggttaacaattaaagagtgtttatcgaaattcattatatagtggtttatatagaccacttcttctgctggttgatatagaaattttatttaattcttgttttttacttatgtacttactacgatgatcttaattcatgcttcttgcttgtcggcaatgtcccaagtggaaaaccagtttaagtagcggaagttactacttggtccctccataccaaatgatattggggagaagtaccagaagcaaccaattacaagtgccatgaatccggcgtataggacgaaccgcatgatacggccgcacttagatctggaccatttttgcaaaccggcgtcgaaacagtacgccaaaatgatcagtgcaaaatacaaggcaggcaagtaatgatgaacgtaggtgactctagacatgataacgaatggcatgtagtgtaggccccaagctagtagtgggtagaacccgcccattaagaaaacgttccagttagatggatttcttaggtccacatattgtctttgccatctgatcagtaagataacgaccgtggccatgaatgcgaggacggcaacactagaagcccacgtggaagctggggtacccaataggaagtattttggattatcatcaccccagccacatagtctcaaacccacattcaaagttggccattgccatgctgaggaagctaagtaatcaaatttgtctggatctggcaccaaagcgttattagtggccatcatggctagatttaaatgaatgaagtcttttaagaagttggtctttgggtattgaaaatcttcgggtcttggtggcaacctttcattttcgtgggtctcgatgttccaccaggtcctcttgtccctcttgaatgggtttttcatgcagacaacctcttgttgtctgaaaccccattcgggcaaactgttaccggtttgagccaagtaacagcccatctccaagttcttgatacggaaagaggtggtcaatgtgtgcaacttctcagggtcttcatctcctctttggtccatgatctcaataacccaattgtctttgttgtcaccaacaacattgtcaccgtaaccagaaacctcccattgtgtctttgacactggtgcagcaactgggtgggtgtgcaagtttctgcccgtgcttttgtgtaccaatctataggaggtacctggcttcaaatactcgatgtcagtttcgttttctgaccatgatggtaagcctctttctctgttgaaaaaccattcgttgttagcatctttgtaaccataacaggttacttgttgttggttggacccatctggataagtttgtatatgtgagtgcaatagagatcctccaagagcttggtttttgatggaaacaacggaggaacctagagcaatgtcacgggggccttgtccgacgtcagaacccactaatcttgcttggaaaagagatggcatgttagcatcacctgtaccagaatgcgataataggtcaaaatgtattttgaagcacaataggaaaatgcagaaggggacgataataagaccaaatattcttgccaaccagtggttaatataggttttccatgacatggatttatctgccaaaaaggtccataagtcaatcacagtatagataccgaccatagtgatgataaatagacccaccattttgacggaaatagtgcaacccaaagaaataccagtgatcaacagccatttccaccactttctagagaacggcttggacctctggttgtggaacataacaaaactaaagaacgatgcgacagtgaagaaaagtagcatggagtccaaaagaatgaacctgcccaaagtactatacgagttttcaaacaaaaccaacacggtcatcagccaaactgttggtaaagaaaatccaatagctttggcagtgaagtaggccaatggcacacagagcgcggaaaatgacgcgttgaacagtctcattttaacataatccaaatagtctgggtaaatttccagaaggaagtcccaagaaccgttgtagcctgccaaataaccagacaacccgaccagcatttttcctaggggaggatggacatcgtggtaaaattcgtgtctcaagtaataagaaccaaatttaccaaagtgcgcctcatcccaaacaacatggttgttgatgccgattttgtacatcctggtaaacaacgccaatgcagtaaagatcaccggcattacaacggattccaggcgtaacagtgagctttgtgcagcgggcttttccttcgagaaatcttccgcgtctctctcatcagcgctcgaaagttcctcactgacgctgatggaagacgattctctttgtctcagtgtattctcttgcttaatgtgggcggcattgtttttgctgtacccggtagacgaagacgaggacatgattgctggaccacggttcgaaacagaatgacagtagcgatgtggactaagccggttctccttggtaatgttgttagtctcgagaaatgaccttttttttaccctcaaaaagaatgcaacactattaataaacagtacacgaaacggatctttccgtaagttctttcgttcttttttttcgtattcttttcttatgtttttttttttcagggcgacgtgtccaataatatgtatgtttgtcgctatgtacgagatattattgctaagtgacagtaaatcgtatcacgactgtaaatgatggcgtttcggtatgtacagtatctatctacctgataataaagtcaattatgaagacgaatacgtagcttatgatgctgcccagagctagtcctgtagaaacgaaaatattagtgaatccaccggccgcttccttctcgtcgtcgttgtccagttgctctggcaccttcatgaaactcatagagatgacgtgcccgttggttacgccgaaaaggaactgcagtagcatgtaacacaagtcaacgattacggagccattgtgctcttcatcgccgcttgaagaggaggtgatggctgtgaacatcaagaacagtggtattgcggccacccgcaacaatgagtagatgaaggttttgcgtggcgtaaatttctggtcacggaacatgggccagtcggcaatgactcttccgtaaaggtcgcctaggttccacagcgtgaatatgagaggtatgtactgtgcgttgcttaaaggaagccctgtcacgtaggtggcagacgcaaatacaggaaaaacaagagttacgacaaacgtggtgaatatggaaagaaccaggtactttagtttggcaaataagacctcgaaaggcacttttagttggagttcctcaccttcgtcgttgtcgtcgcgagtgccgttggtgcggcggtggtcttcatcctccatttggtcaatgcggccaacaatacggatttcctcctcattggagcgcagagaccctaacaacacatcagtgatatgtccgtcttccacattccaattctcgttcactttccgactgattttgctcacgctgaacatgaccacacaaatggtgaccacgagtgttgtggtaaaaaagtatagaagaatcccgcccgtagtagacacagaagagttctcgatgaaagctagggcaaaaagcactagggagggcaggacaccagcaacggcttgccccaccatgacaccttgactgtactcggaaccgaagacgttggctatggccatgataccattctgtgtcatggctgtccccatggaactgatcactacaagcatcattataaacatgaaattgaaccatttaggtaaaaggaaatgcaaaattgtaaagaagcacatgacagtaaagacaataatctcccacacaagcccgtttatgacccttctcgagtatttgtactgtcttttggccaagtagatgttgaacagcattgacgatatggtagaaaaggacatcatagagcttgtgaagatctttgcccaaatggaggtgtctttgaaaatatcgtgcttaaaatattgcgaggcactgaggatacagttccacggccataaaagacctattcctatggcgaaaaatgtaatatatgaaagatttttcaacttttttcttaacggcaatgtatccagtggttcggttgacacagattgctctctttcagaataattatcgccttcttcatctgagtgctcgttgttctctgattcatgttcttctccagagcgtgatatctcctctgaatgcgtatcggccagtgcaggctctggcaccgcaaggattggcttcttgatggtatcagtgtccgcactagtactcatttttgcaatctggtatgctttcttgcgtttgatgataacgtgtcgccgtaacgtaaatcattcatcctttcctatgattttttaagtcaatttttttttctttttcgggaaattaattctgtttttggcattaataacaacaagaagaattaaggattcgttatagaatacaagattcttggtttggttaaataattttggctctcttaaatattataaaaagatacttaagtaagaaagaaacaggacgaaaaagatacgcaaaagagagagagagagagagagaaaaaaaagatgagaaaaaaaagtataacgtgaaggctttatgggaagtgcggtgagattgggatcgtttcaattttataatgaggtagtgtacagagaggagggagggagtgggatgaaagtgtgcggtttatactttcttactgcctgtgtttgtcttcataaattcaaatcttgctaacaatggtatatggtcactggggaatttgtcgttggggaacccgataaacttactcacgtattcagggtccacttcacccaatagcccacgcacccttagagcatgtgtagaaaaccatatatagtcgataacatctgtgaatgacggtgtgaaattggtgaatggtagttctccgatacaattataacttgatttgagagccaagttatgtgagaaatttttctccgacatgtaaccgaaatctctaccatttccctcttgatgtatttggacacggcctgtatttatcaattcgtatacggcggagttgatgtatgaattgaagtcaccacaaatgagcacaggaaatttcttaatgtcctgtctaaaattgtgcgatgtctcctcctttagcagcgtttccagatgatctaacaggacacctacttggaatgtcttgacatcattaaattttggatcccagtgcaaatgcgtggtgaccgcccatatggtgtcgccactaggaatgtgttgtagctttaagaacagtgcaacgttgtctttgttcattgcacggtttaaataatcttcagttctttggaacttcttgtgtttcatccaagcaccgctgaaatccatggcgtctttggtgatcaacttgaattggtcccttttgaaaaaaatgcaacacccgtccactttcttggagtccttggaatgcatggtcttggctcttgcctttgcatggaagatgcctgtataaccgtgcttgtccaataggggcacccaatactcttcaaaagtcttagactccacttcttgtaaacacaacagatcactgtcgtacgagagaatctgctcctttaatttattgcgcctgtaatcccaacttaacgcccacgacggtgtgtaacggtacatttttggggtggcatagtgttgacataaggtgttgtaggataagacggtgaacgtcctcttggctaaatcggtggccagatgctcagtggattgctgcaaagaatcgtactccctctgtggttccccatcggtattgatttcgatgaacctacgttcatgcggtaagggaatctctggtctgttgtcccttaggtagaaaatcaatcccgtgacagatttttctgtaaggatctttaaaaactgtttttctaaggggtttccttctacaccaagaaactgaaggttacacaggttcccaaactcccatggtaatgtggtgaccatgttatcaaaaaagtagaagtatttcaattggaaacatgagcctagttccgctggtagagatgttaacctattatgcgacaggtccaaaacgcgtaggttgcttaggttcttgatctccgctggcagttccgtgaggctattgccattcaaatatagtctcgttagaaaatcgtacttgaagatgttggcgctgatattgaagatttgcaagttggacaaatctagcgcgtgccataattggtcgtcgtatttcgagtccttgggcatgaccattctgttttcaatgtcgtcatcttcgtcgatgctgtactgagacagtttcttgtgttgtaagagcgcctggttggcttcgtccttgccattagcaaacagctctatcttgggagtcaatggtgtagaaactgcactgttagttgccgtgcctgagggagtgctatctcccgtaggttgttgtttctttgctgtcttgctgtcggtgagagtgtcggccatttccatcaaggcttgctttgtgcagtctaccagtgatttggaggcttctgcaatgtgagattgctggaaatcggtgggctgcaaagctggtggtgcagcctgaggtccggggccaaatgggcccgggacctgctgctgtgcctgttgctgcgcttgttgctgagcttgctgagcctgttgtgtagccaaatacttcttcatagcgttttgtctagcataaatgttgggttgccccagagattgtgcggacactgcagccagatgcaattgaagcttccagatcggattgtttagtaaagaagggtcatccaagtgcgggtgtaataaagggttactggcgttcacattgatgttcacaggcgtaccaacggtaggaaccatccctatagaatttactgcggctgtggaggcattcatcatcaccccgcttccaccgccgttgttgttgttgttgttgttgttgttattgttgttattgttgttatccatgttcatattgagcatgttcgcgttcccattagccaattggtcgagcaactggcgcgagttgttgttgctggaagtgtgtacatcgctgttgttcatgagtcccggtggaggtatcccggtgagctggttcatgtgtagctgctgctgtagagcgtttggtgtaccctttcctagtagcccggcatgctgctgttgctgctgttgctgttgctgctgcgggcccacattagggtagcctagtaaagaagggtcgttcattagcggtagtttgcagggataacgtcagtcggagttcccttgctggtgtcccttatgctgtgcccttgtgcttgagaaccttctctaaggtggaaactttttcaaattttttcgttgttggcccgtttttcgcaagtacgggcgataacaaaaggcctaaacggctactttacctttgagatctaccacgatgagaattaatgctgaatggacatctatgtatatgatagtgggtatatagttacttatcagtgctagagcacgatccacgtggtggcacatccgccaaacacgcgaggttttccagagtattggcccacgagctgcagtccaggctgggacgccttttgcgggccgcagttgccatgctctccccagccccagcagtatacattgtaacagtgagacttgccttcttgattagcagtagttagaataccgtgctcactcccggttgcaacaccgacaatagggaagtctaggcgctcttgcgggaagagttgggaatgtgtgcccctaccaaacgactctaccgtattgaggcgcgcattccacaggtggatcgaggtccacatgcacagtaccactagattgtgtcttttttgctgttgtttgagctcgaacccagtgggcaggcgaccggatgcgtgcactatgcggccgccctcgtccactatgaccatgaagtccttgcccatggccacgtagtctacggccacagacccggtatcgtacaccaatacgggctctttcagtgatcgggatttgggctcttgcaattgacactttgtgttgctgccccagccgtatactcgggtgccttgcaccaccacaaagttctggaaacatccgtatactgcgatgcgctcatcgttggaattcaatggcacatgttgctgagtgaactcgtagcaaccgcctcctctctgccatacacggccatcagcatccacaataactgtcgtgtcccagccgcacgccacatccaccacgggtgccggtacttccacgggcctccagtcatgcacctgccgcagtgcttgcgcactatccagttctccccgtctgttatctccacatcctaccagattcccgtcatttgtcagcatcacgctgtggttcccaccgcacgctatcttcctgactattgctccatcatctcctggcacagacctctgtggggtatccatatcctcatcgtgccccagtcccagttgcctttgcccattagacccaaacgcatacacacaactcatcgatacaagcctgttatagcctttaatgatcacattccatcacttgcgctttggatctgcctgcattatcaaggctcaaacggctgcgttacccccgtcgccgcgaaatttttcataatttttcactttgtaggattaaaagagatcatgagcccatctcgcaatgcaacacgtaacttaaatcagtactggcgtgtgctatagtgctctatattcgagtttgttgctactggtggacacccgactatctacagtaaggaacgtaaacaagaaaaagagagaaaatacgctatagttgaaaacatgagtggttcgcattcaaatgatgaggatgacgtagtgcaagtgcccgagacgtcctctcccaccaaggtagcatcgtcgtctcccttaaagcctacttcgccaacagttccggatgcaagtgtggcgtctttgagaagcaggtttactttcaagccttcagatcccagcgaaggagctcatacttcgaagccgctcccatctgggagtcctgaggtagcactggttaaccttgcgagagagttccccgatttctctcaaactctggtgcaggctgttttcaaatctaactcttttaacttacagtctgccagggaacgtcttacaagattgaggcagcaaagacaaaattggacatggaacaagaacgcatctcccaagaagtcagaaaccccgccacctgtcaagaagtcattaccactggcaaacacaggccgtttatcatctatccatggcaatatcaacaacaaatcctccaagattaccgtggccaaacagaaaacgtccatttttgaccgttactcaaacgtcatcaaccagaaacaatacacttttgagctgccaactaacttgaatatagactcggaggcactgagcaagttgcccgtgaactacaacaaaaagagaaggctggtaagggcagatcagcatccaattggcaagtcttatgagtcatccgctacacaattaggttctgcaagagagaaactactggcgaaccgcaaatacggtcgtcatgcaaacgacaacgatgaagaggaggaagagagtatgatgacggacgatgacgatgcaagtggcgacgactacacagaatccacgccgcagataaatctggatgaacaagttttacagtttattaatgactctgatattgtcgatctctcggacctctcagataccacgatgcataaggctcaactcatagcctcacataggccatattcttctttaaatgcctttgtaaacacaaatttcaatgataaggacactgaggagaacgcatcgaacaagagaaaaagacgtgcggctgcatccgccaatgagagtgagaggctgctcgataaaatcacccaaagtataagaggttacaatgcaattgagtctgtgatcaagaaatgttcttcctacggtgatttggtcacttcgcaaatgaagaaatggggtgtgcaagtggaaggcgataactctgagttggacctgatgaaccttggggaagacgatgacgacgacaatgatgatggcaataacgataataataatagcaacaataacaataccgctggcgcagacgccactagcaaggaaaaagaagatacaaaggccgtagtggaaggttttgatgaaactagcgcagaacctactccagcaccagcaccagcaccagtggaaagagaaacaaaacgaattagaaacacaactaagccaaaagtggtcgaagatgaagatgacgatgtagatttggaggcaatcgatgacgaattgccgcagtctgagcatgaagatgatgactatgaagaggaggacgaagactataacgatgaggaagaagatgtggaatatgatgatggtgacgatgatgacgatgatgacgatgaatttgtcgctaccagaaaaaacacacacgtgatctccaccacgagcagaaatggccgtaaacctattgtcaagttcttcaagggcaaacccagactgttaagcccggaaatttcactaaaagactaccaacaaacgggtataaactggttgaatctgctataccaaaacaagatgtcatgtatccttgcagacgacatgggtctaggtaaaacatgtcaagtcatttcatttttcgcatatttgaaacaaataaacgaaccgggtcctcacttggttgttgtgccatcatcgacgctagaaaattggttaagggagttccagaaattcgcacctgctttgaagattgaaccctactatggctctttacaagaaagggaagaattgcgtgatatcctggaaaggaacgctgggaaatatgatgttatcgtgaccacgtataacttggctgcaggtaataaatacgacgtttcgtttttgaaaaatagaaacttcaatgttgtggtttatgatgaaggtcatatgttgaaaaattccacttcagagagatttgccaaactgatgaaaattcgtgccaatttccgccttttattaactggtacgccattacaaaataacttgaaggaactaatgtcgctgttggaatttatcatgccaaatcttttcatttccaaaaaggaatcatttgacgcaatcttcaaacaacgtgccaagaccacagacgataacaaaaatcacaacccgctattagcgcaagaagccattacaagagctaaaacgatgatgaagccatttattttgagaagacgtaaggatcaagtgttgaaacatttgccaccaaagcacacgcatattcagtattgtgaattgaacgcaatacaaaaaaaaatatatgataaggaaatacaaatcgtgttagaacataagagaatgattaaagatggcgaattgccaaaagatgcaaaagaaaagtctaaattacaatcttcaagttccaaaaatttaataatggcattgcgaaaggcctctctgcatccacttttgttcagaaatatctataatgataaaatcatcactaaaatgagtgatgccatattggatgaacctgcttatgctgaaaacggtaacaaagagtatattaaggaagatatgagctatatgacggattttgagttgcacaaactatgctgcaatttcccgaacacgttatccaaataccaacttcataatgacgagtggatgcaatctgggaagatagacgctttgaaaaaattgctgaaaacaatcattgttgacaaacaggaaaaggtgctgatattttccttattcactcaagtcctggatattctagagatggttttgtccaccttagattataaatttttaagattagatggttccacgcaagtgaatgatagacaactactaatagataagttttatgaagataaggatattcccattttcatcttatcaacaaaggcaggtggattcggtattaatttggtgtgcgcaaataatgttattatattcgatcaaagttttaacccacatgatgacagacaagctgctgatagggcacatcgtgtgggacaaacaaaggaagttaatataaccactttaattactaaggattccatagaggaaaagattcatcaactggccaaaaataaactagctttagattcgtatatcagtgaagataaaaaatctcaagatgtgttggaaagtaaagttagtgatatgttggaggatataatttatgatgaaaactcgaaaccgaagggaaccaaagaataaataaataaaaatatagtaaaaaagtaaatagataagcagaaaataaaccaaaaaaataacatatttattttcttctgcgtgaacgcaccatgtggaaaaagagagttgatagaacaaaggacaaagaaatttagaacggtaaaaatattttctagagtataatatacatatatgtgtatatatacataggttagtatgtatagctaggtaattttaatctggggagagaaatggtgaacttttttcaatttattgattcggttgttgattgatatcttgtggtgctgcttcaatttcagcttgagtttctactaaattttcagggaccattggatgatcaaggttaaataaaacgctaccaatagtatttgtagaaatggcaaagcccgctaaaatgggcacggactcaatcaaaccggccaagaaaccaaatgaggcatattggccagcgtggagataaatattttcacgtctttgtatgttgtcgaaattttgtaaacgtaaaactttcgtgaagtaaatttgagtgatgaaaggagaaattaaaatatgaaaaaggattggtccaataagtgggaaaaaagatataaccaacagcacaaaaagaaccgacaggcctaacatgtacttgaccaacttgaatgggaaatagtaagcccagaaatatatcgagttaataggtgcatagtacttgattggtttgacttcactcaaattctcctctaaaccattcttctctaagcacacctccactaaatgattattaaaatgactgagtctcataaacaataaagtgaaaacatttgcttgcaaaaaggaatgaaaaatggcaatgaaaagcccaatagggcccagcacaatcaaaaaagctgtgtacattggcgtaattgtagcccaatacacaaagcttaccagggcaaacattatcaagtaactcgataatatacctaacatagtcgttgagtaactgctcttattggtgttgaactctaaaaaccctttgaacgggtacatgaatgcacctcctgtgaatgcatctttgaaaaagttcattagcacgtatctggtacggctcataactttgctgaagtgcttcttgtaaactttatccaagtactgattgaaggggatgttgacatatggcagtttttcatacgattggcctccgccaaacttgtacaccaaaccaccaatacctgccagcgctaatgaacctgtaaaactcatttcctgttgttgttattgtttgtataatgtacctttgttccctacactataacaacacttattcgtggcaagaacgaaaataaaaaatgatttgaaacttccttttccacatctatatctatatatatatgtatatgtataatacttattactatgatattattccatgtgtcacaaaaccagaaagatcccgtcgtattattgagtcacgtgctttattccatggcgggtaataaatattaaaacaagggttttttaagtaaatgattacatgctaaggaagtggtgaataagatttggcaaggggcaggtcgctaaccacaacatagcattcgttgaaaaggaaatcaacgttacaaagtgcagttttttgtattattttcctattatcctcttcttttcctttgtttcaggcgtcgttgcacctttttgctatacaaaagctcataaaagattagaaaccccggatatcgtcacaacagcggtatattatagttattttgcatctttttggtaagtcagaaattagaaacagtagcttaccaattgagtgaaagtttccgttcgtcatctccctcttttgttttttttcacctttgtttttctgtttcttctatttttgttttgttttgttttgttttgttctctccctaatttgcatataggtaaacatcaaagaagtaatgccctacatcggtgcttccaacctctcagaacattcatttgttaatttgaaggaaaaacatgcgattacacataaaggtacgagcagttctgtagcatctttgcagacaccaccgagccccgatcaagagaaccatattgacaatgaattagaaaattacgatacgtctttaagtgacgtttcaaccccgaataaaaaggaaggtgatgagttccagcaaagtttaagagatacatttgcgagctttcggaagactaaacccccacctcctttagattttgaacaaccaagacttccttcgacagcttcttcatccgttgattcaaccgtatcatcgcccttaacggatgaagacataaaggagttagagtttcttccgaatgaatcaactcattcttattcgtacaatccactttcgccaaattccctggcagtcagattgaggattttgaagagatcattggaaatcataatacaaaacccaagtatgctactggagcctactccagatgatttgcctcctttgaaagagtttgcgggccgtaggagcagtttaccaaggacatcggcttctgcaaaccatttaatgaacagaaataagagccagatttggaacactacttccgctactttaaatgcatttgtaaataatacctcttcctcctcagcagcatcttctgctttatctaacaaaaaaccgggcaccccagttttccctaatttggatccaacacattctcaaacattccatagagccaactcgttggcttatttaccttccatcttacctgagcaagatccgctgctcaaacataataattctttatttcgtggcgactatggaaacaacataagtcctgaaaggccaagttttagacaacccttcaaggatcaaactagcaatctccgcaatagcagtttactcaatgagagggcatatcaggaagatgaaacttttttaccgcaccatggaccctctatggatctattgaatgaacaaagagcgaacttgaaaagtcttctgaatttattaaacgaaacactggagaaaaatacttccgagagagcttcggatcttcatatgatatcgttgttcaatttgaataaactaatgcttggagatcccaagaaaaataattcagaacgcgataaaagaactgaaaagcttaaaaagattttgctggatagtcttgcagaaccattctttgagcactataattttattggagataatccgatcgcagatacagatgaactaaaggaggaaattgatgaatttacaggttctggagatacgacagcgataacagatatacggccccaacaggactatggccgcatattgaggacattcacttctaccaaaaattccgccccacaggcaatttttacatgtagtcaggaagacccttggcaattcagagctgcgaatgatctagcgtgcttagtattcggtatctcacagaatgccattcgcgctttaaccttgatggatttaattcacaccgatagcagaaattttgttttacacaaattactttctacggagggtcaagaaatggttttcacaggcgaaatcattggtatagttcaaccagaaacactcagctcatccaaagtagtatgggcatcgttttgggcaaaaaggaaaaacggcttattagtttgtgttttcgaaaaggttccttgcgattatgttgatgtacttttgaacctggatgattttggggccgagaatattgtagacaaatgtgagttattatcagatggacccacattgtcttcctcttctacattatcgctacctaagatggcttcttcaccaactggtagtaaattagagtattcgttggagaggaaaatcctggaaaagagttatactaagcctacttcaacagagaatcgcaacggcgatgaaaaccaacttgatggagatagtcattctgaaccatcgctgtcatcatcgccagtaaggtcgaagaaaagtgtaaagttcgcaaatgatattaaagacgtcaagagtataagccaatcgttagccaaattaatggatgatgtgaggaatggggttgtatttgatcccgatgacgaccttttgcctatgcccatcaaagtttgcaaccacattaatgaaacaagatattttactctaaatcatctatcttataatatcccatgcgcggtttcctccactgtgttggaggatgagctgaaattaaagattcacagtttaccttaccaggcgggtttgtttattgtggattcgcatactttagatattgtaagttccaataaatctattttaaaaaacatgtttggttatcattttgctgagctggtgggaaaatccattactgaaataattccttctttcccaaaattcctccaatttataaatgacaaatatcctgcgttggatatcacactccataaaaataaaggtttggtattaacagaacatttttttaggaaaattcaggcagagattatgggtgatcgtaaaagcttttatacgtcggtgggtattgatggccttcatagggatggctgtgaaatcaaaattgatttccagctgcgtgtcatgaattctaaagtgattttgctttgggttacacattcgagagacgtggtatttgaagaatataatacaaatccatctcaattgaagatgctgaaggagagtgaattaagtttaatgagcagtgcaagtagttctgccagctcttccaaaaaatcttcgtctaggatatccaccgggacattaaaggacatgagtaatctgtcaacatatgaggatttggcccaccgaacgaataagcttaagtatgaaatcggagatgattctagagcacattctcaatctactttgtccgagcaggaacaagttcccctggaaaacgataaggacagtggcgagatgatgcttgcagaccccgaaatgaagcacaagttagaattggccagaatttactcaagagataaatctcaatttgtgaaagaaggaaattttaaagttgacgaaaatttgattattagcaaaatttcactttccccaagcactgaatccttagcagattctaaaagttctgggaaagggctttctccacttgaagaggaaaagctaattgacgaaaacgctacagaaaacggattagcgggatcacctaaagacgaagacggaatcataatgactaacaagcgaggaaaccaacctgttagtactttcctacgcacccccgaaaagaacatcggtgctcaaaagcatgttaagaagttttcggacttcgtaagtctgcaaaaaatgggtgaaggtgcatatggtaaggtcaacctatgtattcataagaagaataggtatattgtggtgattaagatgatttttaaagaaagaatccttgtagatacatgggttagagataggaaattaggcactataccttctgagatccaaattatggccacgttgaacaaaaaaccacatgagaatattttacggttactggatttttttgaagacgacgattactattatatcgaaactcccgtacatggtgaaacaggatgtatagatcttttcgatctaattgaatttaaaaccaacatgaccgaatttgaagcaaaattgatattcaagcaggttgtagcgggaataaaacatctacacgaccagggtattgttcacagagatatcaaggatgagaatgttatcgtagattctaaaggctttgttaagattattgattttggatctgctgcgtatgtcaaaagcggaccatttgatgtttttgttgggacaatagattatgctgcccctgaagtcttaggaggaaacccttatgagggccaaccacaggatatttgggctattggtattctattgtatacggtggtcttcaaagaaaaccccttctacaatatagatgaaatattagaaggcgacctgaaattcaataatgcagaggaagttagtgaagattgcattgagttaatcaagagtattttgaaccgttgcgtaccgaagagacccaccattgacgacataaataacgacaaatggttggttatttgaaggattaatgatcattctaggacattagtaattggaaaagaaaatgcaaaaaaatatccagtagaaacaatgcttggtatgtcgttcttcttactttcttcagtaatgagttggtagttttctctatttaaatatgaataaatcaatatgtactttctttctttaatcaaaatgttaatatgataaaaatacagcatccaaagcagttaatcaagacttaaatataaaaaatttacatatttagaaaacaaagatagggtaaatattgaaattacatagtaaaccataccttaaaagcagaaatactgataccacatgaactattgatcaatactactgctattctcttcctaatgcaaagagcttattaccattattaaatcactacagacgataatacccggaatgccctttttgcagggaaagcgaaaaaggtgaaagagttaacaggagaaagtgttagggaactaagttacgaaggaaggcagatagcaacaatactaacgtggaacttatttcgacgactataacaactggtatctgattatcgaagaataattgagtggtcagaaaggagcgaaatatgtctggagcaagatcaacaacggcaggtgccgtgccctcggcagcaacaacatcaacaacatcaacaacgtcaaactctaaggactcagactctaacgagtcattatatcccttggctctgcttatggatgagttaaaacatgatgatattgctaatagggtagaagccatgaaaaaactagataccatcgcgttggcactcggtcccgaaagaacaagaaacgagttgattccctttttaacggaagttgcacaagatgatgaagatgaggtgtttgccgttttagccgaacagttaggaaaatttgtcccctacattggcggtcctcaatacgccacaatcctattaccagttttggaaattttggcatctgcagaagaaactttggttagagaaaaggccgtagattctctgaataacgtggcccaagaactttctcaagaacaattatttagtgacttcgtccctttaattgaacatttagctactgcagattggttttcttcaaaagtttctgcttgtggtcttttcaagtctgttattgttagaatcaaagatgattcattgagaaagaatatcctggctttatacttacaactcgctcaagatgatactccaatggtgaaaagggccgtcggtaaaaacctgcccatcttgatcgatctgttgactcaaaatttgggattatctacagacgaagattgggattacatttctaacattttccagaaaatcattaacgataatcaagattctgtcaagtttctggcagttgattgtttaatttccatcttgaaattttttaacgctaaaggtgatgagtctcacactcaagatttattgaactctgctgtcaaattaattggtgacgaagcgtggagggtacgttacatggctgccgatagattttcagatttagcctcgcaattcagttccaaccaagcatatatcgatgaattagtacaaccatttttgaacctttgtgaggacaacgagggagatgttagggaagctgtggctaaacaagtttctgggtttgccaagttcctaaatgatccttcaattatattgaataagatcttacctgctgtgcagaatttgagtatggacgaaagtgaaacagtgagatctgctttggcttctaagattacaaatattgtattactgttgaataaagatcaagtcattaacaattttcttccgattttactgaatatgctaagagatgagttccctgacgttcgtttaaatatcattgccagcttgaaggttgtcaatgacgtaataggaattgagctgctatcagactctttgttacctgccataacagaattagccaaggacgtgaattggagagttagaatggctataattgagtacatacctatcttggcagaacaattaggtatgcaattttttgaccaacagttaagcgatttatgtctttcatggttgtgggatactgtttattctatcagagaagccgcagtgaataatttaaaaaggttaacggaaatatttggctctgattggtgtcgtgatgaaattatttcaagactgctcaaatttgatctacaattactggaaaattttgtctcgaggttcacaatactctctgctctaaccactttggtgcccgtggtatcgttagatgtcgttactgagcaactattaccattcatttctcacttggctgatgacggtgttccaaatattaggtttaatgtggccaaatcctacgctgtgatagtgaaggttttaattaaggacgaggccaaatatgatgcattaattaagaacacaattttaccctcattgcaaacgctgtgtcaagacgaagatgttgatgtaaaatacttcgctaagaaaagtttggcagaatgtcaagaacttttaaaaaattgatactagttcaaatatatacatacatacacatatgtacacttgaatgaataaaaagtatacatattaacaactaggcctgctttcttttcttttctttttttttttttttaccacacttagtcctctactttaacagaaatatcattttccagtttgaccatagtttcttcaactgttttctcctcgtgtttaacattgatttccgcctccacgttcagttcacgttttccttccaggtatttcacccactttggataactcatgatattttgctggatttccttgtacaattgagactgcaaatcccaatctaaggagcttctgggatcatccggtggcaagaattgtaacatgtcaccaaggttcctcgatttagtgattatttgtccaaatccaaccagcaacccatttatttctgtccaaagccccttaggcagccaattttgtaattgagttcttgtctgatctggagtcttgcatttctgcgcatctacccatttccaaagcttggtcaatctatccacgtgaacgtcaacgcagataccttcaatcttgccccatgccttttgtaatgttagataagccattttgggccctacaccgggcaggcccaatagctcattaatcgtagctggaacatcactcgaaaactgatcttgaaggattttgcaggttgacaaaatatacttggccttccttgtgtggaacccaactgaatgaatcaattcgtctaatttggtctcattgatttgtaaaacggcctctaatgtcataccttcttcgctgtgcagttcgtctatacaataccgcattatgttaagcattgccattgcggtaacttcatcttttgtttgcgatgatagcatcaccccaagaaggacctgtaatctgtagtccctcggtgatatctgctctttcgagataccacacttagaggcaaccgttacaggaatggatgatccaccaattatatcgacgggggctagaatcttagatctcagtactcgcattctagcgtatgtttcttgaaacttgtaagggactttcgtcgaggccggagtgacaaggatcgaggggtccaatggtgtggcccacctgttgggcacattgccgtttctaaccacaatccattcgaagtactgcttatttggcagcgatttaacccagtcgatatccacgggttgagggacaacctcttcttgtttgattttggtccttttctccggtaggagttctgattctggcccagtttcagtctttaccagcggtcttttcctcagaattgccatagatgagtatttactgatcttttgcatattttttttttttttgggctataaagtatatatagatacaaatatatgatgaatcattaaagaggaggttattactaagtgaaagaaaaagaaaaaaaaaaagatcaaaaccaaacttcgtattcgagcctaaaaaacagaatataatgttataatactaatagaagcaacaggagcaccactatcagcacaagaataatcacgcagttgccgttatccttgaacctagaattgttaaagccatgcatggaccgagaggccctgttcaaattcctaccattattatcaatcaggttttctaaatcaaccagcagcgagtcgttctgagaaacgatctcatattaaggtccagcgaaatgtcatgagtcctcccaatagactgagacagtgcgcccaagtgggaatcttgctctaacaactgctgttgctggttaataaatagttcttggttggaaaccatgggttgtggtggctgtggctgtgactgtgactgtaactgcgattgcaatggttcatccttgtatggagtatgcgtcgaaggcagcggcgactcctcgtcttgttcatcgtcatccttatacatgaccgtaagctcgtcatcattcttgaaccgcacttttttcaaagactctttggacacctcatcagtatttcttgccacctgctgttggaacctatacaactccttgtcaaccgccgtatcaggaattttgtccagtatggtattgtatcgggatattagttcatcattgggcgcacacttctgcaataactccaatattgagcccaattgccgtttcaaagtaacgttatcgtttgaggtcggggcgagcttcaacaccgacactagccttgttctttcttcgaccagatcagagagctggtccagttcataacccagcttcaacacatccataccgtgtgtgcttacgcatctatttgctgtcgtgagatctgtctctatgctttattcgttttccattgtaaagtctcagcatttatttcttgttctttacttgtttttgccctttcgggtgatcaaagtcgtgctgggaaattttattcttataaaatgatttttagaaataataaactcataacagtgcaacggcaaagtacaagggaaggaagcacagaagcaagaggaggcgcatcgatcgtggcagatgagtcagcaaacaccacaggaaagtgaacagaccacagcgaaagaacaggaccttgatcaagagagcgtgttgagcaacattgacttcaatacggatttgaatcacaatttgaatttatcggaatactgtatatccagtgacgcaggaacagagaagatggatagcgacgaggagaagtcgttggccaatctgccggagttgaaatacgctcccaagctatccagcctggtgaagcaagagacgctcaccgagagcttgaaaagaccacacgaagatgagaaagaggcgatagatgaggccaagaagatgaaagtgccgggagagaacgaggacgaaagcaaggaagaggaaaagagtcaagaactggaagaggcaattgacagcaaggagaagagcaccgacgccagggacgagcaaggggacgaaggtgataatgaggaggaaaacaacgaggaggataatgaaaacgaaaacgagcatacagcaccgcctgcgctggtgatgccctcccccatcgaaatggaggaacagaggatgactgcgctgaaggaaatcaccgacatcgagtacaagttcgcgcaattgcgccaaaaactatatgacaatcaattggtgcggttgcaaacggagctgcagatgtgtctggaagggtcacacccggaattgcaggtctactactcgaagattgccgcgatccgtgactacaagctacaccgagcgtaccagcgacagaagtacgagctttcatgcatcaacacagaaacaatcgctaccaggacattcattcaccaggacttccacaagaaggtcaccgacctgcgagccaggctgctgaacagaaccacgcagacctggtacgatatcaacaaggagcgccgcgatatggatatagtcatcccagatgtcaattaccacgtccccatcaaacttgataacaagacgctgagctgtatcacgggctacgcagcgcacgacagctgtgctatcccggcgagcccgtggcagaggacctcgcttgcgaaagcatcgagtaccgctacagagccaacccggtggacaaactcgaagtcattgtggaccgaatgaggctcaataacgagattagcgacctcgaaggcctgcgcaaatatttccactccttcccgggtgctcctgagttgaacccgcttagagactccgaaatcaacgacgacttccaccagtgggcccagtgtgaccgccacactggaccccataccacttctttttgttattcttaaatatgttgtaacgctatgtaattccacccttcattactaataattagccattcacgtgatctcagccagttgtggcgccacacttttttttccataaaaatcctcgaggaaaagaaaagaaaaaaatatttcagttatttaaagcataagatgccaggtagatggaacttgtgccgtgccagattgaattttgaaagtacaattgaggcctatacacatagacatttgcaccttatacatatacacacaagacaaaaccaaaaaaaatatgactctacaagaatctgataaatttgctaccaaggccattcatgccggtgaacatgtggacgttcacggttccgtgatcgaacccatttctttgtccaccactttcaaacaatcttctccagctaaccctatcggtacttacgaatactccagatctcaaaatcctaacagagagaacttggaaagagcagttgccgctttagagaacgctcaatacgggttggctttctcctctggttctgccaccaccgccacaatcttgcaatcgcttcctcagggctcccatgcggtctctatcggtgatgtgtacggtggtacccacagatacttcaccaaagtcgccaacgctcacggtgtggaaacctccttcactaacgatttgttgaacgatctacctcaattgataaaggaaaacaccaaattggtctggatcgaaaccccaaccaacccaactttgaaggtcaccgacatccaaaaggtggcagaccttatcaagaagcacgctgccggccaagacgtgatcttggttgtcgacaacaccttcttgtccccatatatctccaatccattgaacttcggtgcagacatcgttgtccactccgctacaaagtacatcaacggtcactcagacgttgtgctcggtgtcctggccactaataacaagccattgtacgagcgtctgcagttcttacaaaacgccattggtgctatcccatctcctttcgatgcttggttgacccacagaggtttgaagactttgcatctacgtgtcagacaagctgccctcagcgccaacaaaatcgctgaattcttggcagcagacaaggaaaacgttgtcgcagtcaactacccaggtttgaagacacaccctaactacgacgtagtgttaaagcaacaccgtgatgcccttggtggtggtatgatctccttcagaatcaagggtggtgctgaagctgcttccaagttcgcctcctccacaagactgttcacattggccgaatcccttggtggtatcgaatctctattggaagtgcccgctgtgatgacccacggtggtatcccaaaggaggccagagaggcctctggtgtttttgacgacttggttagaatctctgtcggtattgaagacactgacgatcttttggaagacatcaagcaagccttgaaacaagccaccaactaatcgccagtgccacgtctctgccttcgaccggacctttttaagtacgataaatatccttttataaatatatagtctaaaatatccattaatactgtgctcaatcaatcgtgttagatgatttagttttttccaaatcgttattatagtgcagaagtagtatacataaaggcatatgcatgcgatttggaagtaacgctcgccgtagacaagtaagaatgcctgctgtcttgagaaccaggtccaaagaatcctctatagagcagaagcctgcttccagaactagaacgagatcaagaaggggcaagcgtggtcgtgacgatgatgatgatgacgacgatgaggaaagcgatgatgcatacgatgaagtaggtaatgactatgacgagtatgcttcaagagcgaagctggccaccaataggcccttcgaaatagtcgcgggactgcctgctagtgtggagctgcccaactataactcttcgcttactcatccgcaatcaattaaaaattctggggtgctttacgactctctggtcagttccagaagaacctgggttcagggtgagatgtttgaactgtattggcgaagacctaagaaaattgttagtgaatctaccccagcagcgacggagagtccaacatctggaacgattcctttgattcgagataagatgcagaaaatgtgcgattgtgtaatgagtggaggtcctcacacgttcaaagttagacttttcatactgaagaatgacaaaatcgaacagaaatggcaagatgagcaagagttgaagaaaaaggaaaaggaactgaaacgaaagaacgatgcagaggccaaaagattgaggatggaggaaaggaaaaggcagcagatgcaaaagaaaatagccaaggaacaaaaacttcaattgcagaaggaaaataaagccaagcagaagttggaacaggaggcgctgaagctaaaaagaaaggaagaaatgaaaaaactaaaggaacaaaataaaaataaacagggttcaccttcttcctccatgcatgacccaagaatgataatgaatttgaatttgatggcacaagaagatccaaaactaaacactttaatggaaaccgtcgcaaagggtcttgccaataatagtcaactggaggaatttaaaaagttcattgaaattgccaaaaaaaggtcactagaggagaacccagttaataagcgtccatctgtcacaacaacgcgacctgcacctccctctaaagctaaagacgtagccgaagatcaccggttaaactcgataaccttggtgaaaagttccaaaaccgctgccacggaacctgaaccaaaaaaagctgatgacgagaatgcagagaagcaacagtccaaagaggcaaagacaactgccgaatcgactcaagtagatgtcaagaaagaagaagaagatgtgaaggaaaagggtgtgaaatcagaggatacacaaaagaaagaagataatcaagtggtaccgaaaaggaaaagaagaaagaacgcaataaaggaagataaagatatgcaattgaccgcgttccaacagaaatacgttcaaggtgcggagatcatcctggagtatttagaattcacccattcgaggtattacctgcctaagaaatcagtagtagaatttttggaggatacggatgagattataatatcttggattgttatacacaattctaaagaaattgagaagttcaaaaccaagaaaataaaagctaaactgaaagccgaccaaaaactaaacaaggaggatgccaagccaggctctgatgtggagaaggaagtcagctttaatcctctttttgaagccgattgccctacccctctctacaccccaatgacaatgaagttatcggggattcacaaaagatttaaccaaatcatccgaaatagcgtttctccaatggaagaagttgttaaagaaatggaaaaaattctgcaaattggtactagattgtctggctataatctgtggtaccaattggatggatacgatgatgaagctttgagcgaaagtttgcggttcgaactaaatgagtgggagcacgccatgagaagcagaagacacaaaagataaggtgttcggttactttattctgctttaacgccattatgattatacaattgtattacttattttttaacctgtatattaaaacctttattttatttcacattactcatcatgtggagtactggaattgtatgccaaactttgccgggaaaactggtatattgccgttttctgtatcagttgctgatatagatattgcattatcattcttttcatcatcggataaactttcttgaaagcctctagtgaataccagctctgtcccggcagatattaaaaatcccctccatttgccttcccataatagttttaaagtcttgtcacgtaatgacgtgcttaatttccaaacactggtaaaaatggaactatttattttgttatcaaatttttcgatggtagatctttcttcatcgatttttcttaatgacgacgagaatgcataagttaaatcatttaatagcttttgtttgtgaacaggtatatctagtgtagaaggaatatcgttaacagctgaattcagatccggtacattttcgtgcagtagtttagtcgctctgctgtttggatttatatcaaccaattcgtcggagattggttctaatttatcattattgtttttattggtttcaagcaaatgatgctttttttgccaaaattcgcacccaaatgaaagatttgattcaatcgaataaagattaaaatcatacttcgcgcaaaaagtagaatttgtccctgtcttggccgaatatgtggaggatatatggccgaataatggttgccaagataatgtcaaagttagtggtcgtcctgtgtttgtagaatgtgtgtaatatcttaaagttgtcgaacaaccggggcttaaacttactaaccctaaccaaaattcagcaccaagcgacaacgaagaattattgtacagtgaggtgttaaacttggaaggcgtggtaaggaaattgtgtaatactctataaccacataatagatcactggtggaaaatatccactcctgtaaattgcggtgagaatctctttgaaaatagcacgttaaaacgtttaagctttctttgaaactactgacacccttaagcataaattgggtttgtggacttagtcgttttattatcattgcttctaaatcagagctggggtagtacattctaccataataaagggattttttaacaaatttcgagtcatgtagtaatttcttgtcattgtcgactgtggtgttgtcactactcaacgtattcgcactactaacactgaaattgaggtttggttgcaattgtctgtatgtttcggtggcatcttgtaatgggatatcagtagagttgcgcatgaatttctccaattgctgtgcatcggagtataaataactcagagaaccatttatcctggacctcgtagaaaaatctaaagaattgaatgtattgggagtagatttgttggaaatttgcaggtgtattgctgagggaattcggaaatctaataatgttctcgatgtggccgttatatcctcgtagctattttgcgtactccaatgggtgctctgataaaatgcccttagtacttggtccatatagggtagcatcaagatcggtcttctctgttcgtgtctttttcctaacgtatatttgctttgtttcttcactcaacaataaagtcaaagtaaaattaaatactaattattcttaaaagggaagatgcgaaatttagcgaaaatctattgattatacacacaaaggaagaaaggtagtggaaagctaaataaaggaggtcatggagccagagagcataggcgatgtggggaaccatgcccaggatgatagtgccagtatagtgtccgggcctcgcaggcgttctactagcaagacatccagtgcgaagaatatacggaactccagtaatatctctccagcatcgatgattttcaggaatttgttgatactggaggatgatttaagacgccaagctcacgaacaaaagatactgaagtggcaattcactttgttcttagcgtctatggccggtgtaggcgcatttaccttctacgaactttatttcacttcagattatgtcaagggcctccatagggttattttgcaattcactctttctttcatttccattactgtagttctttttcatatcagtggacaatatagaagaactatcgtcattccaagaagattttttacctctactaataaagggattaggcagtttaatgtgaagctagttaaagtacagtctacgtgggacgagaaatacacagattcagtaagatttgtgagtcgaacaattgcttattgtaatatttattgtttgaaaaaatttctgtggcttaaagacgataatgccattgtgaaattttggaaaagtgtcacgatacaatcccaaccgaggatcggagctgtggatgtgaaattagtcctcaaccccagagcatttagtgcagagattagagaaggatgggagatttatagagacgagttttgggccagggaaggtgctagaagacgcaaacaagcgcacgaactccgacctaaatcagaatgaaagagttggagggcttcttccttcgaataagaggtcatatttacctatgtaaaattgtaaccatctatgttcacacataaattatattttatacattattagaagtgaagctgttgtgtcgtgaaaattttacaaatccgtcatttcatatttaagttttccaacaagtgctagaaaacctaggggttgttgaaattggttaaacaaggcatcttattatacatacaacagcataacgctagaggggcaagaaggaagaacttaaaataataggtgtaaaatgactttggcttttaatatgcaacggttggtgtttcgtaatttgaatgttgggaagcgcatgttcaagaacgtccccttatggaggtttaatgtcgccaataaattaggaaagcccttaactcgctctgtagggttaggcggtgctggcatagttgctggtggcttttacttgatgaatcgccagccttctaagttgatattcaatgattctttaggggcagctgtcaaacaacagggtcccttggaaccaactgtgggcaacagtacggcaattaccgaggaaaggaggaacaaaataagtagtcacaagcagatgtttttgggatcattattcggtgttgttttaggagttacggtggctaagatatcaattttgtttatgtatgtcggtattacaagcatgcttctttgtgaatggttacggtacaagggatggattcgcattaatttgaaaaatatcaaatctgtaattgttttgaaagatgtagacttgaagaaactgcttattgatgggttattgggtacagaatacatgggttttaaagtattctttacattgagtttcgtattagcaagtttaaatgctaacaaatgagcaagacaaatgaccagatataaacgagggttatattctttcgttttatacttttttatttttggtatttcatttatcctatacagtaaatatacatagggctaaggaagaaaaaaaaatcacgtcgaatataaacctaattgtgttctatattgcggacatatatttttcgtagattgaaaagttcttaaacgtaatttttttgacgaccagtgaagaggaattgaataagtagaacttgggcaatacttataacggcaatgataatgataatcaatatagataaccaagtcaaccttgattcggtggaattgacggtagacatgtttctccattctctggctctcaaatagttcaaagtcttcgtgattttgttcaagtttctatctatttcctccacggcgttattggcaataatgtcatcgttattgacatcagcttcatgctcgtcagtcaaagttttttccttttctagtgtaatttctacctttttcaacgctgtaccatagttattggaaaaacaaaaggtatacttccccactccaaacgattttaataaaaagtctgagtacttcttttgtttctcactagtaatcacagatccatcaggagcagtaatatcaaaatcaatctcaaaattaccaccggttagaacttggtaacccacagccagggaatcatcctcagtaaccatatcgtagtacaggcattctttgctgaatgctggtaaactgatagcaactggtgcataactggaagatgcagccactgaattgaccaacgccaaaattaaaacaatgaagaaagagggtagagcaattgtagatttgatcatggttttcctttacaatgagtgtactccactgtttatcttattctagtttgggtcacctgatgcagaattggcggtgtcgatccctaaggttaatgaatcgaaatcactggagattttgttagtttttcattttaactagttcaagttttggcagaatgtactttttcgtgtttcgggacacgtcgctgaaaaggattgaaatataaccaaacgccatcatgtaaggtgcagtgaacattagcgctaagaggattgaggattgctttatgaaagtttatgaacattttcttgaattaaataaataagtctgaaaacacttgaattcgagatgctgtagcaatttgtaatattatttaaagttcacagagtggcttccttggcggatctgaaaaataggtagtgatttaaggctatataatattagatacacaaaacataccagaaattttcctcgaagaccagcagaagggaaccaatatcacgacattaaaatattgttatctctttttattcagtgcttgtatttcagcttccattgaaaacgatgactgtcttctcaatcttcatgtcgagccctcacactgtacatgataatatactagtaccatgaaaactagtcgatagatgataattgatttttatttgaaatagaatctttaatgatcacagtggatcttttaaaaacttggtgagatagtgctagtgatccgtagtctaaatgagttacgtacgaaagggagccaaaagcaatctgaccaatttgtatatatatacatctatccgaaaaggaagacatcaattagtacgggcgtgtggtctagtggtatgattctcgctttgggcgacttcctgattaaacaggaagacaaagcatgcgagaggccctgggttcaattcccagctcgccccgaataatttttttttgcctatctataaaattaaagtagcagtacttcaaccattagtgttagcgataatcaagaagtgaaactctttctctattttttttttaattgaaaaatttcctttctctatagcgtatagaatatatgttacatgtatatatatatataaagtaaaaacgttcggaaaattcctcattatacccagatcattaaaagacattttcgttattatcaattgccgcaccaattggcttaatcaacttcttcaacggttggaccttcagcctctggagctggaggagcaccacctgggaaaccgcctggagcaccacctgcagcgccacctggagcaccaccagcttggtacaacttagacatgattgggttggcaatgtcttgcaactccttcaacttgtcatcgaattcttccttgctggcagtggtgttgctgtctaaccaagaaatagtctcttcagccttcttggtgacggtgtccttgtcagcttgttccaatttgtcaccagcttcagaaatggtgttcttcaaagagtaagcaatggattccaattggttcttggaagcaattctttgagattccttttcatcttcttccttgaatttttcggcttcagcaaccatcttttcgatatcttccttggacaatctacccttgtcgttggtaatagtgatcttgttagacttaccagtacccttttcgacggcggaaacattcaaaataccgttagagtcgacatcgaaagtgacttcaatttgtgggacacctcttggagctggtggaataccactcaattcgaacttacccaacaagttgttgtccttagtcttggctctttcaccttcaaagacttgaatcaagacacctggttggttatcagcataagtggaaaagatctcgaacttctttgttgaaatggtagagtttcttggaatcaacttggtcatgacaccaccagcagtttcaatacccaaggataatggagcgacatccaacaacaatagatcttgagtcttggaagattcgtcaccagtcaaaatagcagcttgaacagcagcaccgtaagcaacagcttcatctgggttgatagatctgtttggttccttaccgttgaagtagtcagtgaccaatttttggacctttggaattctggtagaaccaccgaccaagacaatttcatcgacttgagatttgtccaatttagcatctctcaagaccttttcaactgggtccaaagtagatctgaacaagtcagcacacaattcttcgaatctggctctggtgatggaagtgtagaaatcgataccttcgaacaaagagtcaatttcaacggaagtttgagcggaggaagacaaagttctcttggctctttcacaagcggttcttaatcttctcaaagctctttggttggtagacaagtccttcttgttctttctcttgaattcttggatgaagtggttgaccaatctgttgtcaaaatcttcaccacccaaatgggtgtcaccagcggtggccttaacttcaaagataccgtcttcaatgaacaacaaagagacatcgaaagtaccaccacccaagtcgaaaatcaagacgtgttcttccttacccttcttgtccaaaccgtaagcaatggcagcggcggtaggttcgttaataatacgcaagacattcaaaccagcaatggtaccagcatccttggtagcttgtctttgagaatcgttgaagtaagctgggacagtgacgacagcgtcattgaccttggctcccaagtaagattcggcagtttccttcatcttacccaagaccatggaggagatttgttctggggtaaagttcttggtttcacccttaaattcaacttgaatttgaggcttaccgtcaacatcgatcaacttgaatgggaagtgcttcatgtcagcctgcacttctgggtcgttgaagtttctaccgatcaaacgcttagcgtcgaaaacggtattcgaaggattcatagcagcttgattcttagcagcatcaccaatcaatctttcagtgtcagtgaaagcgacaaaagatggagtggttctgttaccttgatcgttggcaataatgtccacacgatcattagcaaagtgagcaacacacgagtatgttgtacctaaatcaataccgacagcttttgacatattatctgttatttacttgaatttttgtttcttgtaatacttgattacttttcttttgatgtgcttatcttacaaatagagaaaataaaacaacttaagtaagaattgggaaacgaaactacaactcaatcccttctcgaagatacatcaatccaccccttatataaccttgaagtcctcgaaacgatcagctaatctaaatggccccccttctttttgggttctttctctcccttttgccgccgatggaacgttctggaaaaagaagaataatttaattactttctcaactaaaatctggagaaaaaacgcaaatgacagcttctaaacgttccgtgtgctttctttctagaatgttctggaaagtttacaacaatccacaagaacgaaaatgccgttgacaatgatgaaaccatcatccacacaccgcgcacacgtgctttatttctttttctgaattttttttttccgccattttcaaccaaggaaattttttttcttagggctcagaacctgcaggtgaagaagcgctttagaaatcaaagcacaacgtaacaatttgtcgacaaccgagcctttgaagaaaaaatttttcacattgtcgcctctaaataaatagtttaaggttatctacccactatatttagttggttcttttttttttccttctactctttatctttttacctcatgctttctacctttcagcactgaagagtccaaccgaatatatacacacataatggcatccaccgatttctccaagattgaaactttgaaacaattaaacgcttctttggctgacaagtcatacattgaagggtatgttccgatttagtttactttatagatcgttgtttttctttcttttttttttttcctatggttacatgtaaagggaagttaactaataatgattactttttttcgcttatgtgaatgatgaatttaattctttggtccgtgtttatgatgggaagtaagacccccgatatgagtgacaaaagagatgtggttgactatcacagtatctgacgatagcacagagcagagtatcattattagttatctgttatttttttttccttttttgttcaaaaaaagaaagacagagtctaaagattgcattacaagaaaaaagttctcattactaacaagcaaaatgttttgtttctccttttaaaatagtactgctgtttctcaagctgacgtcactgtcttcaaggctttccaatctgcttacccagaattctccagatggttcaaccacatcgcttccaaggccgatgaattcgactctttcccagctgcctctgctgccgctgccgaagaagaagaagatgacgatgtcgatttattcggttccgacgatgaagaagctgacgctgaagctgaaaagttgaaggctgaaagaattgccgcatacaacgctaagaaggctgctaagccagctaagccagctgctaagtccattgtcactctagatgtcaagccatgggatgatgaaaccaatttggaagaaatggttgctaacgtcaaggccatcgaaatggaaggtttgacctggggtgctcaccaatttatcccaattggtttcggtatcaagaagttgcaaattaactgtgttgtcgaagatgacaaggtttccttggatgacttgcaacaaagcattgaagaagacgaagaccacgtccaatctaccgatattgctgctatgcaaaaattataaaaggcttttttataaactttttataattaacattaaagcaaaaacaacattgtaaagattaacaaataaatgaaaaaaacaacgaaataacttaggttttaggctaaaaaaaacagaaggaattttgaacgataaacttttcgactgcacacgaaacattattactaatttgtgtaaccactatataaggaatcgtgtttattaattgaatttattccgggaatattcaagttatgtatatctcttttcatattcttaaatacacatactcataatatcttgtcgaaaatacgcggtgtagggagttatggtggataactttttcacgattagaagaaaaggaaaatttcattattcgtagcttaacatggcaaaaacgagaaagacatataatcaaaacgtgagtttcctgtggaaaaaaaaaaaagggaacctctggttacgatgatatacctgcgtgaaaaaggacagttattaccaatacatacaaaggcttaataagtgtaaaatatatatctgccgagaccattactcattacacctagaatggagcaaaatggccttgaccacgacagcagatctagcatcgatacgactattaatgacactcaaaagactttcctagaatttagatcgtatacccaattaagtgaaaaactggcatctagttcttcatatacggcactcccctgaacgaagatggtcctaaaggggtagcttctgcagtgtcacaaggctccgaatccgtagtctcatggacaactttaacacacgtatattccatcctgggtgcttatggagggcccacgtgcttgtatccgacagccacgtattttttgatgggcacttctaaaggatgcgtactcatttttaattataatgaacatttgcagacaatcctagtgccgaccttatctgaggacccttctattcactcaataagaagtccagtgaaatcaattgtcatatgttccgatggtactcatgtagctgcctcatacgagaccggaaatatatgcatttggaacttgaacgtagggtatagagtgaaacccacttctgaaccaacaaatggtatgaccccaacgcctgccttaccggcagtcttacacatcgatgaccatgtgaacaaggaaatcacagggttagacttttttggtgctcggcatacagccctgattgttagtgataggacaggtaaagtatcactctataacggttacagaagaggcttttggcagttggtgtataattcaaaaaaaattttagatgtgaactcttccaaggagaaattaataaggtcaaagttgtctccactaatatcacgggagaaaatttccactaatttgttgagtgtactcacaactacacattttgcccttattttattatcgccacacgtttctttgatgtttcaagaaactgttgaaccctcagtacaaaattctctagtcgtgaatagctctatttcatggactcaaaactgttccagggttgcttattccgtaaataataaaatttctgttatttccatatcttcatcagacttcaatgttcagtccgctagccattctcctgaatttgcagaatctatattatccattcaatggattgaccagctcctacttggtgttttaaccatatcgcaccaatttttggtattgcacccccaacatgacttcaagatcctgttaagattggattttctgattcacgatttgatgatcccacctaataaatattttgtaataagtagaagaagtttctacctgttaacaaactactcatttaaaattggcaaatttgtgtcttggtcagatattactttaagacatattttgaaaggcgactacttgggtgcattggagttcatagaatcacttttgcaaccttactgtccactggcaaacttgttgaagctagataataatacggaagagaggactaagcaacttatggaaccattttacaatctgtccttggctgccctaaggtttcttataaaaaaagataatgccgactacaatagggtttaccaattattaatggtagttgttcgtgttttgcagcaatcttccaaaaaactagactcaattccttctctagacgtctttttggaacagggtctggagttctttgaattgaaggacaacgcggtatattttgaagttgtagcaaatattgttgcccaaggatcagttacgtcaatttccccagttcttttcaggtccataattgattactatgctaaggaggagaatttaaaagtaattgaagacttaatcatcatgttaaatcctactacgcttgatgttgatcttgccgtcaaactatgccaaaagtataatttgttcgatttattaatatatatttggaacaagatctttgatgattatcaaaccccagtggtggacttgatatacaggatttctaaccaaagtgaaaaatgtgtgatcttcaatggtcctcaagtacctcctgaaacgactatatttgattacgtaacgtatatccttactggcaggcaatatccacaaaacttgtctatatcaccaagtgataaatgctccaaaatacaaagggaactttcagcatttatttttagtggcttctccataaaatggccgtcgaacagcaatcataaactttacatatgcgaaaatccagaagaagagccagcatttccttactttcaccttttattgaaatcgaatccgagtaggttcttagcaatgctcaatgaagtgtttgaagcgtccttgtttaacgatgacaatgacatggttgcatcagttggagaagcagaattggtaagtaggcaatatgttattgatctactattggatgctatgaaagatacgggaaattcagacaacatcagggtacttgttgcaattttcattgcaactagtatatcaaaatatcctcaatttattaaagtgtctaaccaagccctcgactgcgttgttaataccatatgctcctctagggttcaaggtatatatgaaatttctcaaatagctctggagtcgcttttaccctattatcattcaagaacaacagaaaattttatactggaactaaaagaaaaaaatttcaataaagttcttttccatatctataaaagtgaaaataagtacgccagtgcgctttcacttattttagaaactaaggacatcgaaaaagaatataacacggacattgtatccataaccgactacatactcaaaaaatgcccacctggaagtttagaatgtggcaaagttactgaagttatcgagacgaactttgatcttcttctctcaaggatcggtatcgaaaaatgcgtcacaattttttctgactttgactataatcttcatcaagaaatcctggaagtaaagaatgaggagactcagcaaaagtatttggataagcttttttctacgccaaatatcaacaataaggtcgataagcgtttaagaaatttacacatcgaattgaactgtaaatacaagagcaaaagggaaatgattctttggcttaatggtacagttctcagcaacgctgagagcttacaaattctggacttattgaatcaagactctaattttgaagctgcagctataattcacgaacgcttggaaagttttaacctagcagtcagggatttattaagttttattgaacaatgtctaaatgaagggaaaacaaatatatctactttattggaatctttgaggagggcctttgatgattgtaattctgctggtaccgagaaaaaatcgtgttggatattattgattacattcctgatcactctatatgggaaatatccttcacacgatgaaaggaaagatttatgtaataaactacttcaagaagcatttttgggattggttaggtccaagagttcctctcagaaggattcaggtggggaattctgggaaataatgtcttctgttcttgagcaccaagacgttattttaatgaaagttcaggatttaaagcaactgctactgaatgtttttaatacttataaattggaaagatctctttctgagttgattcaaaagattatagaggattcttcgcaagatcttgttcaacagtatagaaaatttctgagtgaagggtggtctatacacaccgacgactgcgaaatctgcgggaaaaaaatatggggagctggtctggacccattactttttctagcttgggaaaatgtacagcgccaccaagatatgattagtgtagatctcaaaactccccttgtcatattcaaatgtcaccatggctttcaccagacttgcctcgaaaacttggcccagaaacccgatgaatattcttgtttaatttgccagacggaatctaacccaaaaatagtataacatttctaaatatttaatacaactttggttacataaaagtaaaatttatacacctcatttcattatgtagattcatatatagaataccaattatgattgacccaatagccatcaaaatcagtagttattaatacttgtctttctaggagccatttgcatatttctgatatttcatgaagcgaaagtacttcacgacacctagattgcaatctactcaatgttatccctggatgaaatattatttcgttaacgaccatagtaactacctgcttccatatgtttggcctaatggaaccagatccattcacccataaacgagaaaatggtttgcccagtggaactttgacagcagacttccttgctgtattcaattttgtctgagaattggcatatataatcagagggggagttaatgttcgtatttcaaatctccttgaagtatacgttaaaggtcgaacatttctcaccattggaattacatccatattcaatagctctcccgaaatcaaatcaattaaaacccaagaggatatatcggacggctcttgattgataacaatagcgtttccggcctccaataattcattaaccttacatctatactgaaaagctacaccaaaatctttataatttcctctattttccaaaatgtctggtaaagtatcagtacattcaagttttgagccatggagataaatttgcttttccttagccatatccatgatgacgttatctattgattcgtttccaacgttcttcaacgcctctatttcatttctagtggtcgaaggactttctattaatatggaccggatcactgtgcgaatataatcgtcgctttgactcttcgataagtccttagtagaagcggaaatctttctagtgtaagttttttttaaagaagagatctctctttgaatcatagaagacatggccagatcgttgccagaatgtgtaagtgtgtcatcacgtaccagagtaaatttttttctattctcttcgtagttcttataaagaaagagcggcctttttatttccttttcatcaaaagaggtccaaatatcaagcaatttgataagatctagttcttcaacatccctcagtgaaatcttttcacttttaatggctagaacgagcatttttttccacttatcgacatatgccctccaaccactatgacccattcttactcgccgtgccgtccatttcttttttaggttatctaaagaattattaggaaataattttgttattttgtcccacattatttcatttttaatacttttagtaactacaacagctctgattaaagcctgaacaccatctttagtgcctgcatgatagacagttttgtcttctttagtattttccacgaccaccgttgtcctaccagcagacacttttttgtctctccttttgatctttccatctgatacgttgaccgacgtactcttcttagagatagcgtcatctgaagctttgatcttagcattcttttggcggttctgaaacttacgaattctttcaactgatttctttcctctgtgaaacctatttttttccgtttggtcaaagaagtatatttccgtatcatgtataacatcagtaaaggttgcttttttactatctttttctttcaggatgtacctttggatagcgtcctctccaacagtgggcaaaaaaataatttttcttcctgatacaggctctgttctggctcctaatttttcgctttctaccatcaaatcaacatcaccacggacagtctttttatctaatgtcgttgtggagcccatatatttagaaacgctttcgtaaaattgttctctcaggtatgctaccccaccaatcgtattcataactttcaaaatggctctctgtctctgtagtgaacgcaaagagcgggcagaaaagccgccgaagttaaccaccttgcctttgacaacagtgcctccgtttgaacttggactatcttcagcagatttcggctcctgtgcagtgctgacatgctgctctagcttaatccttttgggattcgaaatgtttcctgcaacagaagcattagtactgtttttaacctgcctcttccgtttgtttttattcggagttttttttgagtttgggggaatttttaattcaccgtgccagaagaatatatcctgtccatcgctgtccgttgtaaatctaacagtgttgttgagtgcgacgaaattatcctcgttgagagttttcaaatcggtacgagatttgcctagctcatcaaacccttttggaacggatatttcgtcttccgcatttgttaacttttgaaagttctgagctgtgaacagcctaaaaaacttcttctttccctcaaaatcgtatatgcgaaaaagcctatacccccctgtattttctttttgcttatccacactttctaaataatattcgcttgatttggtaaaagctcgctgaaattcttttccggtaattcgatttacaacatccatagttgaaattcctttaaggccagacttatctgcaatgtcataagtctgattttgaagtggataaaatcgattaagaagaacttcattctttacagcatcctctttctcttccataacaaggccttgattttgtaataaatcagtcgcattgaaattatctaaaccttcgactaagtcttcatcttcgaaagctgccttgctatctgatacagaatcttcatccgcgctattgctatcatactcaaatgaaggcgagcctttagagtctggaatatctttcacgtattttacacatctgattttaatggcaggattcttgggtgatactacaagcactttctttaagtactccttttcatctaaccatgcaatagctgcaataaaagctttagaaagtcttttctctttgtcaaatttcaattcacgctttaaatcaattatctggcgaataccattttttgatcgttttaccacctcaactattgttgctaaatgatccctaatattaatatagggattactatccaccccgtcatggctgaatttttttagcttcaattgcttcacgacgtgtcccttataaatcagttgtgaacttgttaacaggtggtttattttcttgatacgtccagtcacacttctaggatcttgcccagttacctgcgccaaatccatagtattgatccctttttctcctgatttggcaacttcgagaagtagttcaaatgcagaatttccaatagttgactccttttttgtgtatcccgttaataatgtccataggctgtcctcagtaatcccaaccgagtatgaatgattagcgtcgcctataatatcagtcacatttttagttgttatagcaccatcacaatacacctcaatgtcctttttcaatatcacgcatgaaagcacgaactgtttaacttttttatcagacaaatcaaaatatttaccagatatatcccacagctgattcaaagtgatttcttcaatgtgtcgttagtaaataatctttcacaatatagtacgtttatcacctaaacggagccgaaaaggagaatgagacatgaacatacttcccttatttgaagcaattttatcagacactatttgtacgagttcgtcaggataaatcgtcagtaccatttttcttgtggctagttggcttcaaccaaacgtcctcttctctcttatggcaagaagaaagttatatgtgtgactggttgtttatttcactttcgcgactgaaagcgccgccctttatgatgcaaaaaaccaagcggtatttgaaaatgcagatttgcagaaataaaagaaataaaaataaaaatcttataattttaccagcttcaataactcgatttgcataagtgtgccttagtatgcttattatattgactttgacattgaacttcaaaaccttttatgtaatgatttaagtcttgtcacatgacataataataaataattttaaaaatataaaatatttttaatagtttttaaatattttacagtttattttttaaatttatttatatgtttttgttttccgaagcagtcaaagtattttaattttcggagctttcatttcaagcgccttttttttacacataatacgatcaagataaattattatagtggtacagaactcttaagcactaggcggtggaccttattagctcaatcttgagtcagtccatgtatcgttttataatacttttttaagcactttctttaataaatattccattgaagtactgttactgaaatgagatgaactgttcagaatgtagaaatggcgccagaaatcaatcattgtttagcaaaaacacctttcgtctgctgcctcgggtgttttttcaaattatttcagcaggtaaattaagatagttattcgagtgattgccaaatatcatgttctacttcgaagacttatagctaattaattttttcataatgaaggtgtcgttaattgttctgattagtaacatgaaactcaaaaatcatcaaaaaaagaaaagctaaatgtatacttttttgtctacattagttaccttttattacatgagaaagttatttttcttctttttttttttttttttttgaaactttttcctctcggaaaataaaagatatatttacaagtgaaagcttattgtaatgtgtcattttaaacatcaaataacagacctttacatcaaataagcaccgcaagatatcctaaaatcgacatccaatgcatcgtaaatcattgaggagggctagcgctactgtgccttccgctccctatcgaaagcagattattagcaatgcacacaataaaccaagccttttctctaaaattaaaactttctttacccaaaaagattcagccagagtgagtccaaggaataatgttgctaataaacaaccacgcaatgagtcttttaacagaagaatctcaagtatgcctggaggttatttccattctgagatatccccagattctactgtaaaccgttccgtagttgtttctgcagtgggtgaagccagaaacgacattgagaataaagaagaggagtatgatgaaacacatgaaactaacatctccaatgcaaagcttgcaaacttttttagtaaaaaaggtaatgagcctttatcagaaattgaaatagagggtgtgatgtcattgttacaaaaatcaagcaaatccatgataacttcggaaggagaacaaaaatcagccgaaggtaataatatcgaccagtcgcttatcttgaaggagtcaggaagtacaccaatcagcatatctaatgcgccgaccttcaacccaaaatatgatacttcaaatgcgtcaatgaatacgactttgggaagcattggttcaagaaaatacagtttcaattattctagcctgccctcaccatacaaaacaaccgtttatagatatagtgcagcgaaaaagatccccgatacatacacagccaacacatctgctcaaagtatagcatctgctaaatcggtaagaagtggtgtttcaaagtcagctcctagtaagaaaataagtaatacagctgcggcattggtctcactattagatgaaaatgacagtaagaagaataatgcagcttcagaacttgctaatccatactcctcatatgtaagccaaatacgcaaacataagagagtttctccaaatgctgcaccaaggcaagagatcagtgaagaagaaactactgttaagccattatttcaaaacgttcctgaacaaggcgaagaaccaatgaaacaactgaacgccaccaaaatttcaccatctgcgccaagcaaagattcttttactaaatacaaacctgcaaggtcctcatccttacgctcaaatgtcgtcgtagctgaaacctcacctgaaaagaaggatggtggagataaacctccatcctctgcttttaacttctcgtttaatacttcaagaaacgttgaacctactgagaatgcttataagagcgagaacgcaccatctgcatcatcaaaggaattcaattttaccaacctacaggcgaagccgttagttggaaagccaaaaaccgaacttacaaagggcgattctactcccgtccaaccagatctttcggttactcctcaaaaaagttcatcgaaaggctttgtttttaatagtgttcaaaagaaatcacggtccaatctttcacaagaaaacgataatgaaggtaaacatatcagcgcctcaattgataacgacttttcagaggaaaaggcggaagagtttgatttcaatgttcccgtggtgtctaagcagctaggaaatggcttggttgatgaaaataaagttgaggctttcaagtccctatataccttttgataatgaaaattttagccgtgacataattaccgtatagcccaactcaatacgtaagtttgtgtaaaataccattccaagatgatattatttagtcattttttttccactttctcaaaaagaaggaatacctttagcggctcttataaactataaatttctagaagatacataaaaggtttttagtctgatcataaaattttttgcttaacaaaaaatttgcccaggtgtttcatttgccagccacaagtaacagcgagaacaattaattgaatgacaatccaccacatagcacgagaattaacagcttcagaggcgtctctaaaggtagcttcacgatctctcatcaatttttgctctcttctaatttcgccgatcttggagtttaggacgttaaccttggcatgtagaatgtcaatagtggctttacccttagaatctaacttttcatcagagcccacttggaattcaacgtcaatcttcgttttagccttaatcaaccagccaccagcttcgggctgaatacagattttatgttcacccgaatcagacgcaaggaaagttaaatcaccacttgctgaacctttctgatgaacaaccaggtggttatcatcaaaagtttcctcaatatcaatcaagacaccaaaatcttgcgcaccagcgtctctgtaattttgtaattggtcatcgtaaatttgtgccttgtaagttgcttggaacaaagtacctttagacaattccttgtggaagcacttacgttcagcaccagaagtataataatagaacgcagtaacttgagctggtaaaactagacagcaggcaaaaacctgtaaaagagaggttaaaagcatgattagtagagagattggttacctttaaatacttttccaaactacagagggaagatagagtaagttttgtatgtacacatttctgctgatgtgtttttttttttcaacttattacgcgattcgttttttttttacggtaacagaatacagaataaattcacgtacaaaaatagagaatatataaaataataggttgacgattatattggatcttcccctggggttcaagagtcgagaccgagtccttttagtttgtgtatatcagctggttcttttcgttatgaacatccttttacaggatccattcgctgttcttaaggaacatcctgagaagctcacacatacgattgagaaccctttacgcactgaatgtctccagttcagtccttgcggtgattacctggctcttgggtgtgccaatggagcacttgttatttacgatatggatacgttcaggcctatttgtgtcccaggaaatatgttgggagcacatgttcgacccattacatctatcgcatggtctccagatggtagattgttgcttacaagctctagagactggtcaataaaactgtgggatctttcaaagccaagtaagcctttgaaagaaatacgattcgattctccaatttggggttgccaatggctggatgctaaaaggcggctttgtgtagctacgatatttgaggaaagtgacgcatatgttattgacttcagcaatgatccggtcgcaagccttctcagtaaatcagacgaaaaacaattgagttcgacacctgatcatggatatgttcttgtttgtacagtacataccaaacatccaaatattattattgttggaacttcaaaaggttggctagacttctataaattccattctctatatcaaacagaatgtattcattcccttaaaatcacgagttctaatatcaaacatttaattgtctcgcaaaatggtgaaagattagctattaactgctccgatagaacaataagacaatacgaaataagtattgatgatgaaaactctgcggttgagttgaccttagagcataagtaccaggatgtgattaataaattacagtggaactgtatcctctttagtaataatactgccgaatacttagtcgcttctacacatggttcttctgcacatgaactatacatctgggaaacgactagtggaacgttggtgagagtcctggaaggggctgaagaggagttgatagatataaattgggacttctatagtatgagtatagtgagtaatggttttgaatctgggaacgtgtatgtgtggtctgttgttattccgccaaagtggagtgctttggcgccagattttgaagaagtagaagagaatgtcgactatttggagaaggaagatgaatttgatgaggtcgatgaggcagaacagcagcaaggactagaacaagaggaagaaatagctatcgatcttcggacgagagagcaatatgatgttagaggtaataacttgcttgtagaacggttcacaatccctacagattatacgaggataattaagatgcagtcatcataggtttctcttcaaaaggagaaagtttaaataggcaactgacactgaagaggtatagtcatgcctaccgcgatttctttgacacagaattgaaaaattttgcattttttggtaatttcctaataatacgaagtgcaataatctcactttgataggagcacgtcatgatggtaatttcatactactgaacgtaaatgttgaaggtgaatttgtaaagctttgttatttgaagctgtacacctaaagggcggtaaattgttgggtgttagtaccatgccattaattagaatttgttagcatttttattcatttgtgcattatgggttcaaattcatatgactgaacgtgtagtttcatatccagtcatcaagagatgctgaaccgcccttcaaaaacttgacgaaatagaagttttttttttacatttctcatatgttacatagattaaatagtacttgattatttgatacattaagctaacaaagccttggataactcatcggcaagatagtcggcttcagccctgtaattcaagctgtgtaggttagcaacggtatatctaattctgctttgatcattgtatgtatcctcacgcgctctaatcctaaagtcatattcgttcatttggatactttgagtaatttttgtgaattcgttggggtcttcttccttcaaagacattaatgtattagcatcaacacccaataattgtttagcttggtcgtcaaataaagtgagccatagttgattggtttcgtcaataattgatattgtcaagatgtatctccaatttggccttgcattattggtgtcgcacttctcacatctccaagtaccatcaggctgttccagaactttcttattacaattctcattagaacaggcaggatatgcaaaattatcaacttttaagaaacttatagcagctttaacactaaaaaagtcacctttctcgcttcttcctagattttcagcttgagctctagcaatagtaatacgctgagcaatgaattttgttaagctagcagccgattgaccacccataccgggttcttgctttaaagtgatgaagtttgcgttgcggcccttggaatcataccaaccctttaaggcatatgcctcaggaatttctggattcggaatcagggtactagaaaatcccatagacaaagatttgccaccaaaatccgtcacacgaacacctttaatggcagcaacagaaccttcaggaaggttgaaatcaagggcttgctgattccataggccaacagagatagaaaacccagagtcgtcaacaattgtgatgtcacgacgatcgaatttcttcccagcccttgaagttagctcaaaatgtgggtttatagtttggataataccgaggacgtctacgttggaatttacttcctggttctgaatagcatctagtttgatgaaattgaaatgggttttcggaacattactttcatcgaaacattcttctataacagtgtctctatccaaattcagttcataagggtgtgttagattagtaaattggggcttagctggttggagttttgcctttgatacatagtatactttgccttcttgtaaaatttcgttaaattttgtagcaaaatcattaaacgccgtggctcggatttctccagaggtatccaagaagttgacattgaatagtttaccatcacctctttgattgtgccacgttttaatttctcccttgtaggaaactcttgctttgatagtccaaacgttttggtatggagacagttgttcgatggcaaaaattggtctggttttttgcgaattagggttttcattggcgaattttctctcatttgcattcaagtttgagtttgaatgcagcatatcagggacaccagcattgctggcgtttgtttgattggcaacattaccactgtcagttatatcttcgtcttttaaggtttcatttggatgctctgagaaatagttatccaaaaaagtactagtttggttgaccatatcagcacgcgactggaccaactcaaagtcatctactaaaagaacgtatttctttctttccctgacaatagcaggttctgcaattatcacgcgaatgatatcacccctttgtagttccattgactggaacttggatgcagcttggtttctcaacagagccttcatatggtaaataccatcggaaatcatgatcaaattctttctgttgctgttagccccatcagatttcctggtgttataaacttgataaacgccaccggtgggattatcgtacctttgcttattggtgaagatgctatgaaaatcgcccctcgaaagttgaacactgctcatctcttgtaagtataatctggtcttcttgctggtttcgcctttaccgtaataagaagagtgaatagtttttgttttacgtgtagaacttaaagtgataacatttgttcaagtaaacctttatgttagttcacgcgtcttttgtcgcctcgtctaatttttacgcgtgacatttttccaagcagagatattttattgagcagcgaagaagagttagagaataagaaagtgatgcgataagaaatccacccaattagcatagatcctttcgtatatggctgaagaaggtggtacgcgcatagctattaacatatatcaaaaagaacggcaaaaggcgaggaggtttttatgccaccgctagtatttgacatagatcacatcaaacttctaaggaaatggggtatttgtggtgtgttatctggaactttgcctactgcagcacagcaaaatgtatttttgtcggtacctttgaggcttatgttagaagatgtgctgtggctgcatttgaacaatcttgccgatgtgaaattaataagacaagagggagatgagattatggagggaataacattagagcggggcgccaaactatctaaaattgtcaacgatcgtttgaacaagtcatttgaatatcagagaaagttcaaaaaggatgaacacattgcaaaattaaagaaaatcggtagaatcaatgataaaaccacagctgaagaattgcaacggcttgataaatctagcaataatgaccagctaattgaatcttctttgttcattgacattgctaatacctctatgattttaagagacatacggagtgattcagacagcttatcccgcgatgatatcagtgatttgttatttaagcagtacagacaggcaggaaaaatgcagacctatttcttatacaaggcattgagagatcaagggtacgttttgtccccaggtggacgttttggtgggaagtttatagcataccctggtgatcctcttcgtttccattcacatctgacgatacaagatgcgattgattatcataatgagccgattgacctaatatccatgataagtggtgcaagactaggaacgactgtgaaaaaactttgggtcataggcggtgttgcggaagagacaaaggaaactcatttcttctcaatagaatgggctggatttggttaagctgggaatcagtcatgtataattattttctcagaatttatgtatttataaggtttttcagaagcatacatatgtgtaatacaatttttaaatttgcattgatattttgatgcattcagcgggaaagtagttgtttatcactagacatataattatgtttatttatatttagtgggagcaaaacagtttattgaatgtttaccagaaccgaaaaaaaagctcttctaaactgttgacatccagttcatttacttccacgtgtagatgtgaaggaacaaatattttagcatcgttcatacaagtaattatgctatattatcgatcctcggatttcagcttccgttatatcggatgattgttactcgacctttatgtcgtctttttacatcatatatgataatatgctagcagttttaatacaaattgatcgaagatagttggttctgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacataccacccataatgtaatagatctaatgaatccatttgttagttaatagtttaaatgtttttatcggaagaggttttgtcatcacatcagcaatgttcttcttggtctcgatgtagtatacgtataaattattacctgatacttcatctctaagtctcattgcctttgtgccaaaaaatctgtttctaaatttctcttcatttgtagacttaattatactgatcgttgatctactatcagtaagtaagcctttaataattggtttcttgttaagttcttgtatcaggtaacttagattatttaataatgggacagattcacttatcgcgtgtatttctgcttccgtagttgaagtacatgttaatgaagccttggtggactttcctccaattacctttccattaagtaaatatatgttgccaatttgtgatttataatacggttggttgccatacgaagcatcacttattgcgactagtttattatctggctcggtaggtttgtttttgtgccatatcagttgtttatctctagtgtcccacatgaattgtatcaactcatatgtcatgtctaaaacttgcctagaggggaatagtatatgttgagcaagtgtgttgatgtagtatagtaagtcaaatctaaatttatatccaacatatgaagctagaccaatcaacttttgcatttcatgtaccttctctttgtattcatcttcatctatttctagttcatcctggtctatataaagacctggttgacctggagctctaagtttctttccttttgggttcaaaggtacgtttagtttgggtaatttttctgtcaaggatttttccatacctaatttcatgtatttacctctttgatatttgatttctaagccaagtatgtcgtactgaatttcgttatcactttcacccagatttattatctttgtatcgtattgtttcttgagtgttgttatgattttcttatttgcatttaagtctttgctgaacaatatcatatcatcaacgaataagcaaattgttacttgactattcttaaatacgcatgaccatccacgaacttcttccataccacactgttttatcaggtatgatttgatagtttcgtaccagttcgctccactttgtttcaatccataaagtgatttcttcaaacgtatcaacttatcattcattcctaaatgtggtggaggtcttatgtataattcttctttgatgtctgcatacaaatatgccgaagatatgtctaattgtgtaatatagtagttattgtctaatgcaagtgacagggatgtcatcaacgcataatgatgtacagtgttggattgcatacctgtatcgtacgtatcaggatgctgaatgtcacctcttgcaacaaatctagctttatgagttccgtcacgtttcttgttgaagataaacattgagtttattactcttttagggtctatttcttttctgtcataatatttgtcagtgtcccaagtattcattttcaatagttggttgacttctttgtggtatgcctcgatatatttttctttttctttaatatctttattataggtgattgcctcatcgtatcgtaaggttgtccgtattggtttgattgattttactgcttttacagctgcaatcaggtgaattcgtttcttcgatctcggaggttctaaactacgcatattcttagtattccatgtgtctcgtgataccttaatttcagtttcattatcttctaatgatcttttcttactgttgatagtagtataggcattagagtcaccaataccacccaaactggaattagtttgatgagaatttatcggtgggagttctttaaatgggtcagggaattcggtaggagattctggaggtagatcagggagtgggagatcagcgatgatagattcctcggtattctgttcagaaacagtagttggcgttttgataggaacaatattgtgcgatgaattattttccggtggagaagcatcgattgaaggtgaacggtgtataatccttttctcagtctcttggtcacttatctgcggaacagttttgttgttggtaccacccgtactggatattggtacgtttgtatgattagtctcattttcactgtacgagtctgagtgtctgaaatctttagatttactggcgtgcgacgactcatgtgtgttagattgggacatgggagcaagtaaaggaacatttaatttatgcataccacccgaaccggtactctcgatattggaaatttggggggtgctagatctcttctttgatggaagaatattagattcagatatgttggggtcaacttctctgggtgcgcgaatattggttttagaaacacgtttcgaatcttcagtatgagttgacggaggtgtggaatcggttggactcacagcttttgaaaggacatttctcggttgctcaggatgtagttcaatgtcggattggaagtcatggtcagattctatgttaagatcattggattcttggatctcatttgacgcaatgaacgaatgatatgaagcagttaaacggtttaagtcttcatcgaaagtgagtgcgtcgtaattgaattgatctaatctggattccttgccctgaagaataacatagttagttgtatctactgtcttctttaaggatggaagatagatgatatatccataagagtttcgagacggatgtagagcgtagcctgggatgccacgaggatgtattttggagttagggttgtgatcattgacgataacaggttgaccgaaaggtaacaaagtactgatatcaagtcctgccaagccagcatgttgtcttgcagattttttgcttttaggtgaagctagtgaatttctcacaatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccatttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacgcaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaatttgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttactgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatcagagtccgctgaggatgaatcagtaaatgtattacctgactcaggtgatggagtgctcagaggcgttccaactgatgatggatactgcggaaactgtgattgtggcccaggtggaaagtacataggcgacatttgataaggtgtatacggaatcatagatgggtgtccgtaaaatgaccaaccagatggattggcttggttttgggtcatcatgcactgctgtgggtacggcccattctgtggtgaatgtgactgagcagtttgaggagaggcatgatgggggttctctggaacagctgatgaagcaggtgttgttgtctgttgagagttagccttagtggaagccttctcacattcttctgttttggaagctgaaacgtctaacggatcttgatttgtgtggacttccttagaagtaaccgaagcacaggcgctaccatgagaaatgggtgaatgttgagataattgttgggattccattgttgataaaggctataatattaggtatacagaatatactagaagttctcctcgaggatataggaatcctcaaaatggaatctatatttctacatactaatattacgattattcctcattccgttttatatgtttatattcattgatcctattacattatcaatccttgcgtttcagcttccactaatttagatgactatttctcatcatttgcgtcatcttctaacaccgtatatgataatatactagtaatgtaaatactagttagtagatgatagttgatttctattccaacaggttcttattttcaacaatgtaattgatggccttaaatctctactacatcataaagcttctaagcacttaccattccttcataagtctagtattgtaatgagttgggcacatggcgcagttggtagcgcgcttcccttgcaaggaagaggtcatcggttcgattccggttgcgtccaaatttttttgttaatccaacacaattgaattcgtgaatagctgactgtcatcagtaatgttcgtggaaagtacctatccatactgttgtatcacgactaagtagttgtcgactactacctcctcaaccccagttatatccctatgacacattggaggatgctgaataatgacagaattttattcctccttttcattatcataatctgaagcaaagttaaaaaatagaagaagtaagataaactttgtagatacgatatatagttgtttgttttagctatcatatatgctgaactgttactaccttattttttccgaaatgtttctaaaacaaataaatattcatgaatatgatgcaagttcgttggatgagaaaaagaccaggctttattgtaaggacaatatcatttacgaataatttcatccaattggtttcatcaacacatccattctgtcaaaaactggagcatagagatgttgaaccaaagaattgggcttcgaagccggatcggacatattggtattagacaatgcccttgatccggaaagtgaactatttatgcttgctgatgataccgccctttgttcatccatataaaaatcttcttcagatgatgagtgtaacgataaggttgattgcttttcttcttcgggggtactgtgatgtttttctagctcctctttaggttgttctgcgtcagtttgatttggcattcctccactagaccccaagctggcttgaatttgccctctgtgttttccacgtttgttgtctctcaattttcgattttgcatgatatatgtgaatgtccttattgctctagatgatggaatactgctgctttcttcaactattggagtggatggtgattcgtttgtccattctgacgacgacggtgaaaactcgccaattgttgaaagggaattttgagagtctgattttgccataccattcgcaaatggcatacgaggcgcttcaaatacttttttcagatcggtatcgtaatcactgtcaaccggttcagacttttcttgccccacataccgatttgcattataatcatcttctctgtctttactcgatgatgtcttaggctcactttcgtttttgttgtcttgtctccgaacttttttcacatttagtggtgtattcaaagatgtactaaaggagacgtcgctcactacatcgctcgtatcatcatcctggaatttggcaaaatttaacttcgcttcagtgtattcgtcccggtgcgttacttttgtttccttgtcgttatcaacatcatcgtcgtacgactgtccattgccttcaccgccatcatcgttactatctaacgaggtatcttcaattgcatcatctataaacctgtctgcataaccgacaacatcattgaaactaacagatttgttccccttaccatatccattcagtgcaggtgtcggaattatactctctgcatcactctgattcttgttaccagagctgatggaatcatctttcgaatcggaggaagcaaccgattgagaagacatgttttcatttttccagcaattcaatcgagctagtctttctggaaaggtttctagaatttccgctggcgcaaacccgattttaccatcagtgatcctcttaaccagccaccaataggcatcctggtcattcaaaagtatacaaggttcgtcttgccctaattgacaatgtgaagaatcatggccattgaacgcatataaagcatatagtttatcagggtccagttctcttggcggcgataagggttggtaatcgtcgttttcctcctccaaatcgtctttctccccttgaaaccctgaatcttgaaattttctgtcaaagtcatcgtcatcagagtagttttcctcttcatcctcgtcctccgagatggcgtatttcaagccatcactaaaatcgtcaacgtcagggttcattgtattattcactgaaaaatgcacctcatccttatcggcgctatccacggaatcagtttcgatctcttgtagccttctttccaaattgtcctcaaattcagaatccgaataatcatatgagtcgggcaattccgaagaattttctttgtaatgtcgctgatcccttttactgttgctatgcatatgtttttccacgttctcctcctctaactctttgtcatcatctctatttcgcagaacatcatggcccttttctgccgcattactcagtatattaagtttcgaattgaagggcgaactcttattcgaagtcggagtcaccacaacacttccgcccatactctccgaatcctcgtttcctaaagtaagtttacttccacttgtaggcctattattaatgatatctgaataatcctctattagggttggatcattcagtagcgcgtgcgattgaaaggagtccatgcccgacgtcgacgtgattagcgaaggcgcgtaaccattgtcatgtctagcagctatagaactaacctccttgacaccacttgcggaagtctcatcaacatgctcttccttattactcattctcttaccaagcagagaatgttatctaaaaactacgtgtatttcacctctttctcgacttgaacacgtccaactccttaagtactaccacagccaggaaagaatggatccagttctacacgatagcaaagcagaaaacacaaccagcgtacccctgtagaagcttctttgtttacagcacttgatccatgtagccatactcgaaatttcaactcatctgaaacttttcctgaaggttgaaaaagaatgccataagggtcacccgaagcttattcacgagtcagtctgactcttgcgagagatgaggatgtaataatactaatctcgaagatgccatctaatacatatagacatacatatatatatatatacattctatatattcttacccagattctttgaggtaagacggttgggttttatcttttgcagttggtactattaagaacaatcgaatcataagcattgcttacaaagaatacacatacgaaatattaacgataatgtcaattacgaagactgaactggacggtatattgccattggtggccagaggtaaagttagagacatatatgaggtagacgctggtacgttgctgtttgttgctacggatcgtatctctgcatatgacgttattatggaaaacagcattcctgaaaaggggatcctattgaccaaactgtcagagttctggttcaagttcctgtccaacgatgttcgtaatcatttggtcgacatcgccccaggtaagactattttcgattatctacctgcaaaattgagcgaaccaaagtacaaaacgcaactagaagaccgctctctattggttcacaaacataaactaattccattggaagtaattgtcagaggctacatcaccggatctgcttggaaagagtacgtaaaaacaggtactgtgcatggtttgaaacaacctcaaggacttaaagaatctcaagagttcccagaaccaatcttcaccccatcgaccaaggctgaacaaggtgaacatgacgaaaacatctctcctgcccaggccgctgagctggtgggtgaagatttgtcacgtagagtggcagaactggctgtaaaactgtactccaagtgcaaagattatgctaaggagaagggcatcatcatcgcagacactaaattcgaattcggtattgacgaaaagaccaatgaaattattctagtggacgaggtgctaacgccagactcctctagattctggaacggtgcctcttataaggtaggagaatcccaagattcttacgataagcaatttttaagagactggcttactgctaataagttgaacggtgttaacggcgtcaaaatgccccaagacattgtcgacaggacaagggccaaatatatagaggcttatgaaacattgacagggtctaaatggtctcactaacgtgatttacatatactacaagtcgccagtgtaactcctcactgaatatgattcatacatacccgtatgtattaatgtataaatgttctcagagcaaattttatcgatatcttgtttgccagtggtatgcaggtttggcaaattttttaccataatatccgtttatagattctggaaccttaccaactttcttaccgctaattacttccctggctcgctcctccactgcctgggtaaattgttccttcaactgactcagttctctttcgtattcaatagcttgcttctcgaggattttttcaatgtttgtcagctcattttcatagtccagtaacttcctttcaaatctctctaattgcaacgactttcttgcagttcgtatctgaatatcttgcagtaattcaaaagtggaaggcctggttcttaagttcacatctatcattgaatgtattatggcattaagccctctagagtaatactcagggacggtgtcacatttcccgtttttaatcttagtttgtagctcgagataattttttgcctgaaatggggggtgcaacgaacacatctcaaaaataacacaacctagtgaccagatgtcggatagtggggagtatggttggtccatcaacacttcaggcgacatgtaatatggtgtaccgacgtatgttgtggcaaattgaatactagtttccagagatttggctaacccaaaatcacctaactttaccacaacttgactatagtccatagggctcccccttttccctgaattcactctatggtctctgtaataattactattcacttcctcgtgaccgtctacttgttcattaatattgtaatcgctatcatcatagcttaagaatatatttcctggtttcagatcacgatggataacgatgtttttgccttttaccggtggtttcatccggtcatatattgtggtcaaagttggcaattcaacaccataatgacatttatagagcgcagtcaataattgggccaggataccccacacaattttttctggtatatatttatgctcctgtttgtagtgcttaatcatctgggataaatcacccctggaacaatattccatataaaggtataacacttctttttgttcatcgaagtcccagttataaaattctacaatattttcatgcttcaactgcgatagaatgctacattcagcgatcagctgttgtctctctttgctattcatatggccatatttgatatcctttctaaccaaaagtttcttggtaggtatatggatgacttttcgtacagacccaaatgaacctctcccaatttcttcgagaacttggtattctgaccttggtgggtgtccctgctgctgctgaggactacggtattcttggaaaaactgtcgtctatgcatactcacacagagaattgattcaattatcaaatagcactctcattgaaattagtattgtgaatcttgctcttttcatgttatatgatttgatattcttttgaaaagtcgcttttatttacgtttaacctaattaggaaacgtaatgaaaaaattcagaaaccttaaaaaaaaaacttggctgtaactatcggaagactgtgccactgcaatcatgtcagatatcgtatttcagatttattgatctatagctagaaacatttaacaaaatgccaccttctagagtcggttcatacatttaatccccaattgaaaaaaaaaaagaaaaagaaaaaaagcatatatagatatgcttttttatcattactggcctctttaaattcaaaaacttttctgatctcttttccaaacagatgcgttttcagtattggaaggttcacaattctatatatagtgttaatgtaatgctgtattattctctatatatgtatgtatgcacatgcaattcctacattatgtttgaaatgttgtaatggggacggaaaagccgtcacttttatctttggaggatcgcaaattactacgctcatcttttgttggagaactaccaattgctgcagtgacgcttgaaactttttgcaggcttcctttttttgataatgaacggatatcctcacatagctgacagatcaaaactgagtcccccccaacttgatttgaattcctttttggacatccgttgttccagttgttgtttaaaaactccgttatttgtactaaaatggcacgaagtttgaaaacagtggccttattacgacgatttggttcggtttgctttataggatccggctgtcctgtgtagtcatatagcttcaataacgattttgagaatattagctttatgaatttcaatagatcgatttgaataagtaaactgttgaaataggtatcaaagaaagaaacaatcttttcataaaagttcgggtgaaatatgatattaattgtaaggttttcaaaaccgggcaatgagcatatcttcgtgaaaatgctaattagtttactgaggttaacgtcatcgtcattcaatgcataaaacaggtcaactaattgatcaatcggtaattcaatagcagcgtcattgttgacctttatgaggaaaacactatgagactctgatgagcccactgtaggagccacatcatcatttacattgcgtaacgtaaaatgcaagcagttcagtatgatctccagtccacttatggaggtgttattcttttttctgatgaaattcatagctgtagaaaataaagaagcactcatttggtccatatccaaactcatttcaacgcatatagcagtgatttgtttccaaatgaaagctgctgtctttgcgtcgtcgataaagggaatgatggtatcaatattccggataaaagcaaaaaaagcatcgttgtcaagcagatcatttaaaaaagtgctgtttatatgtactgtaaggtaacaaagcttggtgaagtactttaaaacagataaatctttgatttgggccatgtcaacaaaaaaagatgttagccaggtaaagaaaccctccggtaattcaattagtagtcttgattttgaagatatggtcagatggggaaagtttgaaatgctcttgtgtcgcattggagaagagggacgcgttgccatcaaagaatgaacaggggaccttgatggagactgtaccgaattcactggtgagttcctcgtgggtgaggaggataacggtagagaggaagaagaaggaatagcggacttgtgtattttatcgtcattcgtggttatcatatagtttattgatttgaagactacgtaagtaatttgaggactgattaaaattttcttttttagcttagagtcaattaaagagggcaaaattttctcaaaagaccatggtgcatatgacgatagctttagtagtatggattgggctcttctttcatggatgttattcagaaggagtgatatatcgaggtgtttgaaacaccagcgacaccagaaggctgtggatgttaaatcgtagaacctatagacgagttctaaaatatactttggggttttcagcgatgcaaaattcggaggatacattattccacattcaattaaagtctgagggtagtcgatgacgaactctttggctaaatgttcgaatttaatgatcagtggaattcctcccatagcgatgaatttcagtcgcaacctagagtggttatgctgggtatcgtaaacaaaaatggagccaaatgcagttattaatcgtttatcaacagttgtgcgcgacagacactcgataattgtatcagcgatgttctcgagggagcaaacactgaaaagcacatgcaagtccgtcaaaggcttagatgaactcttcaattggctcagcaattgactttcagtggggggcattaaatctagttcttgattgttttctgcccagggagcgggagccgctcgaagactgaatttagagggtgatatatttagtttctcttcttgaaaatcggcatcccaatgataatcagcgtcggtaaagtcctccttgaacttgttgagcttgtcgaccttcacattttcggtagagttgatccacacatgcttgagtaactggtcggctgtcggcctcttgtacatgtttttcacaaagcatttagataagaaatcctttagtggctcagagaaagagctaggtgggtagtaggtatcattttcaacagcgtagtagatattggcgtctgtcaaattgtggtagggtggattctttgtgagcatttcaactacagtggcacctagagaccaaatgtcgctgagcgtagaagctcccctgttgcccaggatctctggagccatccaattgagtgtgcccgctagcgttaaggcgctggagttcacaatagtggaaacgccaaaatcagcaagtttgacagtgttatcagcactcagcaggatgttagccgccttgatgtccctgtggatgactccttcaccgtgtaaatatttcagccccaatagtgtctgtgtcacataggttttcgattcattttcacttaatccggtagagctccttgaaatgagcctcctcaaagaaccattagcgcagtattcgaggaggatatacaattcatagctttttcgtatgaagccgtggtatttaacaatattgttatggtttaaattttttaacaagctaatttctgccataatgtcattaagttcctcatcattttcgtacacgacctcctttattgccacgacttggtcagtatgtttattaatggctttgtaaactaccccgtaagaacccctcccaatgacctgcttcaagtggtattgcacggatttctcagatgccctctggatgggagtcaagttgactctatcggtatcggccatactgttcatggtatagtcttaccaggaaaatgggtagtgcttatgtgtgttttgtccttcctcgagcctccaagtagaagatataccttttgtgaggcagatctcccgtatacaaaaataacagcaagaaaagcggaaagaccatcgcaaggtggaaaggattataatggcacagcaaagtcgcacagagcactacagtatagcatagagtgctaatgagttgataggcccaattttgattatgccttctttttcatacacgacgccagaggacattattacattacagtagttcgccgctagatgacaaacgacatccttaccgatatgagatgtgcaaagctacataatggcaacaagcgttatgaacagccttgtctttacgaccacagaaaagccgtattagagctcttcagctgcaaaattttcttctaatatgatgcaaagccatcaaaaatcatgcatagttatgaaatacctgatgaaacgcttcgagttcgtgctcaagaaattactgaaaggttaccgagaagaaaaatatctatgagacacgataaggccccttctgaatccattgtcctgggcttgttcattctatttaccacttaaaattgatcctttcaaaggaatttttttctatttccaatagtatatttgtacaaaaactacaaaaatggataaaaaataacagtaatttgtgactactgtaaatatcactgatttggattttgtaatgagtactgctcatgcccatgccgatgcaagtggatcataaattttactaaacgatattcgataatgcgccaagcctttataaggaactcaaaataacccatatggacagtttcagaaggccaaataacgatcaaggacattcactcatgtttttcaaaggcgaagagtgtaaaattttcttctatatagttcgaatattttatcttataaatttcagtcgtcattttccacattcgaactcaaataatgataaagaacgctgcagtaatggcttaaaaaaacatactttataacccattatctcttacgtgtaatttaaaattgtttatagtactatttggttatgcttgtatgcctctattatttacttgatctttttatgttttcttatgattgaattatttatattctaaattcctcacgaatttatactgaagatttccttccaggcgagaataataaacacatatttatgatgataacaagacgaacgtgtattaagctcccagtacgagggaagcagtaaaaattatcccaagatccatttaaaatggataactccacgagctacaacaaaatactaagggaataggccgttatttccgtaaaggatggtttaataataagaaatttataatattaataatacatatatacaaaaatttatatttatatacatgcgcctaactattcatactattaatttcatattattaagctttttttttttcatttatcattttttttcgtaacctctcatacctgtacaggtttcattcgtaaagcagggactctagtttgcgatagtgtagataccgtctacggatagagcactagagatagctggctttaatctgctggagtaccatggaacaccagtgataactctggtaacttggtcggcgggaataccagtcaacatggtggtgaaatcaccgtagttgaaaacagcttctgcaatttcaactggataagtttcagttgggtgagcagcttagaaagagtagtattcagccaaatgagctctgatatcggaaacataaacacctaattcaaccaaattaactctttcgtcagattgagataatgtagtggttgctgcggcggaggcaccagcagcaatggcggcgacaccggcagcgattgaagttaatttgaccattgtatttgttgttttttgggttattgcttagtgatgatataggcttaactggaaggaaaagaacagagaaatgtctcaaacaaagctgatcaagccgctgtatttatatgaaacttgaacaactacatctgcacacatgggctcttactggtcgcccatctcacactcatgccttccacattccacttagcgactaagtcattattactatggggacgggttgttcttgaacgatgctatacttcgtataggaagccgtttttttatgccccatcctttcatatgttccatagcacaagaatgttctctacaggaaaagtgcctatagggctgcagctgcagttttggccaagaaatagaaccaaagccaaatttattttgggccctcgttcaagggccatctcacccttggcactaaacggttagtaggagggaaatcggacttttcccaaattagaaacaatgaaaaattaagtgtgagctcttagagtcgcatctgcaggaatatgcacacaaaaaggggagctgtacgtaaataatcagaccacacaaactattgccaaccatttgatactcacgctagatatgatgggggttcttgtttggacaacacaagtctcagagccagcgtagatatgcttgtacataaatgacgactggggcatcaattgaatcgggttacattgtgcgagctattacatgaagagaatatgcctttagggtaatttccaaatgtaggaagtctcgctaagtagggcgcccaaatctgtatagcgatgttgttgaggccatatagtaaaatgacgtgccaattaccgagcttttgatggaggtaaaatctaagattaatcttgcgccttgaaaccactagaaatgaaaggaattggtgaaaaaataatcgcgcaatagatgacatggaacgacagaagtcttgtattgtgcacgaatccgcaatattcaaagccgaagttcatatacgaatgcgaactatttcttagggtagctctctgtatgggccgccataaattagtaccaaaagataggtttttgaaaaggctacaatgtgcttttttccttcttgctttcgagtccggtgaacagaatattacgacgtccttgtattaagagccagacctcctgttagcgtcactataagagtaagtctgaaatacgcaacaactacagtgcaatgaaaaagtgctcaactcaatgacaataaacaatttaaccatgggaggttaaaatattactgcgatcagtaaaaatggggatatcaccttttgacacataacatagcaataaagtaacagatcattagtgatcggacaacctgaaccaacgatataatgtcgaagccaccactacctttaagattagtagcgctgcagggggagacaatgagagaaatttcccgccacatgaactgagtcaggagttttttttttcttgctggagaatcatttaatttcatggttaaactcctctataagcatcccattctcccatgcctgaaaacacttttgtccattcgatcctcatgcagccctcgttaatatgctaaaatggctcattaaattgtaagattgtatcgttcgagaacgtcaggcatgatagatggttgcaattacaggacattgattatttaatcctgctctcaacatgttcaataagttgaagagttgctgatctccccgtatatcttatgaaccaaagcatggtgggtgaatgttatggttatccttgttgaaaaatgattgatagactggattgagcggaaaaacatgggtcaatatgctgatcttgacatttttcaaaatccacgggggatcaaatcaacttcttatagcgtatgacctcttttacattgtttaatgatgttaagattgcgatattatagtcagttaagttactcaaacgcacagatttaatagaaaactgcgtcttcgttgcctagtcgatcataataaattcgcagattatttcgaatttgatctccttcgaaatcaagtttattctcttcacaacaaaaaatgcttttaacttgaacaaaactcgtaaactatttccccactgttgcttcgggacgacccagttattcaatatcttgcaatgctaattttttttgggagagcagttgcaaatattgcaaacacatctaaagcgtacccacaatttatgacttcctggagcccagaacagcccaaaaaaaaaaagatgcgttctttttataccaatatattagatacgtaaactctactcatattgcaggtatgcccacatctggatattgactttgccaatattcccgcacagcatgggcttgaatttcggctgctttaaagaggcaccactttacggttggttcaacatcagaattttgagttgcagcctgattttctggaacactgatgaacggctgtgtattcgctgtatcccactgtacatcaggatattttccctttatgagatccttgaaaaattcatagcactggtgttcacaaaaaaagtggtatggtgttttccataagccagccttgaacaaatattgattcatgttatacgttatggttttccattctttcccagctatcgatggtctatgagttattacctctagtagaagttttgtacggaatgtttcattacttattggtctactgattgaccatatctgaaggactaccatagagccacctaaacatatccggatcaccatggcaggggagagaacaccagaaacccaaatgtttgttaaagtcgccaaaatcgtcaagacaaaaaggaggaaattgatcattatatacttggcgcgtacaatttcgtaaagcaaataactctggtatgatgcaaactcatcctctggaaggacgatatcagctgagattaaaggactttcagggttgtcaggagatccttccctcaatgggattgctttaggatcgtccgtgacatgagtgttttttttaaataagattgcatgtttaacaaacgatttaacttgcttttgcttacaagtcaagtaaaccttatcctgatagcttaggaaaaatagacttgaatgtgtcgaacatttcaaacctcaattggtattttcctttttttcaactgtacgtacatagcttttcgctttctttagcgcccccagatgaaagtatatatcgtaacaaggatgggaacatgaaaggtactgaaaaaacatctgtatttattaaaagtaaatcaaaagcagactgggaagttctgtcgtagggattttttttttaatgttatgtgtgtaggattattctatttccttgaatttctcgatcgagatttttcgtacctgtgtatttttggatataagagtgtttctgatctattgagtgagcaggtctccagcggaatatagagtagattgaatatggaagaggactacattaaggcttattgttagttagttactgttaggacgcttcggcgagctgatgtctgacttctcgttgtatcaaagagctcccaatacgccagcgcatttaaactatgatcacggaatgctggattagtagtatagcaaaagtaacacttgtccaccgcagactccatcacttagtcaacaccttgggtgttttaccgctgataatggccgtaaaatcgccagatatatatcatcattgttcttcgcgaataatacgtaacacagtctcttttcgaaatttagatgaggaccataggcatgacttatttactgagatgtccctgcgttaaaacttttactggccgattgctaactttatatttgttaataaaactattcacgcctgtgtcctaattgttggataatacctaaacaataacgatgttgtatagctaagaggacgaccagacaaaaagttataaactttaccctcgttgaaaatggggcagccacctatgaatcacttcccattacaatgccgaatagatatgtagtagaacacgtacacgcatgataattacttccatgctgtacttattttttgggtgtctcttcagaaagaatgctttatataaccatgtgtttgaattagcgatcagctaataacaagtcagtgtccaaatagttaaaacattgtgacccaaatatcacaaataagtggttgtttggccgagcggtctaaggcgcctgattcaagaaatatcttgaccgcagtgaactgtgggaatactcaggtatcgtaagatgcaagagttcgaatctcttagcaaccattattttttctttttcctcctatacttcataatctacgtaggaatgaaagtaccaacattataccaatgagggtgtgtttcgtggatgcatatactctgaagataaaaacaaactcaagtccgcttcctacggtttgagtatttcttaccactacataataaagaatattacgttaactgtaaaatcaagtagacttggaaaatacaacgagaacactttcctgattctgcatcagcgttttcttatcaccagctgtacttctacattagctaactctcctttctataaagggcgtctttcacttcacttgtgccatgttacaaagctccaaacgcacttctaactgagtacaatgcacgatcccactgacagacaaaacagcttcacagaatttgatcatgccatcgtaaaaaccacgtagtaaggaataaaaaatcccgaagtcgatcatactatgtagagatgtacatgaatagtctaggaatctggtcttccagcatgttgctttggtctgcttcaagcgctatggaagcgctcgccatgagatatgctgtttcaaggcaaaatagcaaagctctttgtaaagaaatacaattcagagaagaagctacagcattttgtttctggatgatccctgcaggttcatactactaagtaaatcttgaacagttcaaatttcaacaattcagaaaccgctctttttatatatactctaccaaacgagatgaaacagcatttttttactcttataaggtaccaatattttgacgtatgctttctttaacgttcacgatcgggctgggccattaaacttaccttagatattatttggaacagcaccgcaagtgctgatgtcccagaaatgggcgccggttcaattaggtcgtgaagtcagacatatggagactctcggactgaaagcactaagggatgatagctggcatgccaattccattttaaatttacacatcaagttacagggtttgggaaaatcacgttcaaagcctgaaaatttgaggttgttcacggaaatcatttggttatgtctgtcggcctgctatttagagacattttttattgcaacaacctactctatgcacttacacggaatcgcagaataacgcgcgcacaacacaattgggaaacgataggattttgaatagtgtattgctttgtaccgatttaaataattctttctcgtgttgaatccgagttgaagatgagtatgctttgaagaggtgaaatatcatcagtaaaaaaaaataacgacaactgcaggactcgaacctgcgcgggcaaagcccaaaagatttctaatctttcgccttaaccactcggccaagttgccaaaattgtatgttatttgttgtatctcaaaatgagatatgtcagtatgacaatacgtcaccctgaacgttcataaaacacatatgaaacaaccttataacaaaacgaacaacatgagacaaaacccgaccttccctagctgaactacccaaagtataaatgcctgaacaattagtttagatccgagattccgcgcttccaccacttagtatgattcatattttatataatatataagataagtaacattccgtgaattaatctgataaactgttttgacaactggttacttccctaagactgtttatattaggattgtcaagacactccggtattactcgagcccgtaatacaacattattttcagtgataaaatatgtaaaccaattataagaaaaaggattgcgttgcatcacaactgtaaaccattaattaaaaagagcaattgctatttagatttgttgctgagaattggctaaaaaatctgataattgtaggacttctattattgctaggggcaatgtgttggaatgcaattctgttggaataaaaatccactatcgtctatcaactaatagttatattatcaatatattatcatatacggtgtagagatgatggcataaggtatgaaaagctgtcatcgaagttagaggaagctgaagtgtaaggattgataatgcaataggataatgaaacatataaaacggaatgaggaataatcgtaagattggtatatagaaatatagactccattatggggattcctagaccctcgaggagaaccttcaagtatattctgtatacctaatattatagcctttatcaacaatggaatcccaacaattatctcaaaattcccccaattctcaacatccgactgccatgcaatgtgcttttctggatctcactcatgatcataatggccctgtaaaaggctcgcactattattattatatcttcactatatattatttcggaggctgtacctatcagtgaaaaaacgcctctaaaaatgaaaaaaaaaaagaatatgaaaggggttctgaattgctaaaatatttcgtcaaagctcaattagtatcatgatcaagtcgtaattcgaatcagcataacaacctccaaaaccatataataaccttacacaagacaagatatcaattcaacatgcaaaccccttcagaaaataccgacgtcaagttggatactctcgacgaacccagtgcacatttaatcgaggaaaatgtggctcttccagaggatacattcaattcgtactggagttatatacttaatgaaatcgctcgttgtaaaccgctaatgattatgttcctaatacctgtgtgtttggttttattgattacgttttttcatgatatcaaaggtatccttgtgtttttagtgatttctcttatcctctctattatcattttattgatcggtataactgccttcgtgtctgagaccttgaataagggtttcataattaagcttttagtagaagtcattacacgtaaaccagcagtaggggggaaggaatggagaataatcgcatataatatgaaccagtatctgtttgaccatgggatatggcatactccgtattactttttttgtgaacataggtgccataaatttttcaaaagccttatcaaacagacaaggtcgaatgcacatttgagttcaccaacgaacggtgcagagaatacgcagtcaaacacaccagcaaaagaggtttcaaatgagatggtaaaaccttatatctttagttctgatccagttttagaagcttaccttattaaagctgcggaaattcacaaagaagctgaatttgagtattggagaaagcaatacccagaggttgatttgccttagggccgaatttttggtatttatctagtatattctaatataaaatgtacgagcatcattaacttcaagaacattacgaagcccgcaattaagtgtcagtccatctgggtgtaaaagttatgtacgctcgaaacaaattttatgtagtttactttagatgcaaatgctattatatattttgctttatgatcctcggcttgatgctcgccaacgtgagatagctggtcatcacaatagatcagccgggacgcttttcgatcacatcgaatcccttcgggacgttgcaacaatacgtgaaaaatgcctcaaaaataataaatacaatggtgaacaacgttaaaaaagcataaaacagctggctattttgatcaggataacatctataagtgccatattaaggcaagatatcaattgaccatgcaaacaccttcagaaaataccgacgtaaagatggatactctcgacgaacccagtgcacatttaatcgaagagaatgtagctcttcccgaagacacattcagttcacatctgagttatgtactttatgaaattgctcattgtaaaccgatcatgtttatgatcatcataatcgtgagtttgatctcattgattgtgctttttcatgataacgacgggtgcactgtgatcttagtgatgtcccttatagtagcctccatggctttaatggtggttgcagcattcacattcgggaaagcgatcactgaacaggagttcatgataaagcttttagtggaggtgatcgcacgcaagcctgcggggaaggaatggggtactgtcgcatataatatgaaccaatatctattcatgaagagactatggtataccccgtactatttctatagcggcaagaagtgccatgagttcttcaccactcttatcaaggaagtgaattctggttcgcactcggattcctcatcgaatagtgccgaggatacacaatcacctgtctcagcagggaagacttcaaatggtctaaacaacttttatagtattagatcagaccctattttgatggcatatgttttgaaggcaacacaaatagaaaaggaggctcaaagtgaatactggagaaagcaatatcctgacgctgatttaccttgaagcggaagcattttattcaccaagtatacttacttttctttaaaacgagaacaagaatcgaattcaagaacatctcgaagccagaattgagcatcatatattcgagctgtacaaacatcatggcctacaactatcgtatttgtaagtttttttagaggttttcatatttgtttaataagggttctgtcagtttttgtcacattctattgttgcgcttcgcataatgcagccaagaaaatccaaacaatagaaaaagaaaaaaaggatctcaaaaagggtttggtgttgtagttataagaataactagtgaataaaaaagctgttgtttggtccgtattacattcgtcaaaaatttagtactcaaatcgtgtatgcaatcgcaaccacaaaataaaaatattagactggatgtgttgagtggagatggtgccaatttagttgagggaaatgtggtccttcccaaagacatgttcaattcgtacttaagttattcactttacgtgttacgagggggctcattgtaagccgataatgattatgttcctggcatctgtaattttgatttcactgactaatttccgagtataccatctcatgtcccttctatcctcttttttcatctccgggacagaccgacaataaagcatctaatattaggctttcgttagaggtaagcacacgccagcgttcggtgaaaggggaatgaaacattatcacgtacaagatgaataaatatctatttgaccataaaatatggagtactccttactacttttattgcgaagaagattgccaccgtctttttctaagttttattgagggaagaactttcgagaagccaacaagcaacgctgaggaaaatgtacaggagactgaagctggcgaatctttcacattaaatcccggagaagattttcaaaattgctttccaagacagcggatattgtagaacaatctcaagtgaagtattggcaagatattggtgcaattatttgaaaggaaggagaaatattctgacagtaccttgctagcaaagggatttaccaatccactgacgctaaaatggggtagtaaattagataaattgcattctaacgtgactttatatagtgggaaacagatatgtagcacacaaaacggcatgattatgcttaattgattcctattttttaacgtaaatactctcccagaacgatcagaaaacttaacccgcaaccatctttgctgtgctaacaacttatgtcgcctcaataccatttttattttgtatcattccggaacttagtattgaatgaaaaatgcctccgaagtaaaaagcaggtgatgaaaagtttcaattggtataagacagatcgctattttgatccgcataacatccttcaacaccatagcagagctatagagaagacaagatataaactgggcatgcaaacatcttcagaaagtaccgacgccaagtcggattttctcgacgaacccagtgcatatttaattgagaaaaatgtggctcttcccaaggacatattcggttcgtacttaagttattggatatatgaagttactcgtcataaagcggcagtaattttgctcgtacttattgtgacttcaattttattattagtgtttttttataatacggaattttgcgttgcctttgagatactattgttttccttttgctttccaggaacatgcatggttgtaattgcatttagtgaaccgatcggtgatcgggaatttaaagttaagcttctgatggaaattatcacacgtaaaccggcggtaaaggggaaagaatggaggacaattacatacaagatgaaccagtatttatttgatcatgggctatgggatactccctactacttttaccgtgatgaagattgccaccgttattttctaagtcttattaagggaagaactttcaagaagcaaaaggaatcgtcagccagcaatgttaaagacgcacaatcaaatgacgaaaccgctggcacaccaaacgaagccgctgagtcttctagttttagtgccggaccgaactttataaagctcctcaccaaggcagccgaaatcgaacaacaatttcaaaaggaatattggcgacaagagtatcctggtgtcgatgagtttttttagacagaagacgggagacactagcacacaactttaccaggcaaggtatttgacgctagcatgtgtccaattcagtgtcatttatgattttttgtagtaggatataaatatatacagcgctccaaatagtgcggttgccccaaaaacaccacggaacctcatctgttctcgtactttgttgtgacaaagtagctcactgccttattatcacattttcattatgcaacgcttcggaaaatacgatgttgaaaatgcctctagagatgaaaaacaatcgtaaaagggtcctgcgtaattgaaacatttgatcagtatgcagtggcacagaaacaaccaggaatactatagtcataggcaatacaaggtatatattggctatgcagacccctccagaaagtaccgacgtcaagttagatacacttaacgaacctagtgcacatttaattgagaaaaatgtggctcttcctaaggacatattccgttcgtacttgagttattggatctatgaaatcgctcgctatacaccagtcatgattttgtccctggtaataggggttttggttttattaattatattttttaatgacaacgaagcttgtgttttcaattctgcaatatttgcttttacttctcttgtaggtttgttaataatattaagtgatggtaatccaaagctagtcagtcgtcgaaattttaggaccgagcttttagtggatgtcatcacacgtaaaccggcggtagaagggaaagaatggaggatcatcacatacaacatgaaccaatatttgtttaatcatgggcaatggcatactccgtattacttttacagcgatgaggattgctaccgttattttctacgccttgttgagggagtaacccccaagaagcaaacagccacgtcaattggcaattctccggtcaccgctaagcctgaagatgccatcgagtcagcttctcctagttccagactgaattatcaaaactttttgctcaaggcagcggagatcgaacgacaagctcaggaaaattactggcgaaggcggcatcccaatatcgatgcgcttcttaaaaagacggaatagcttagagacactaccatacgtaaagcgaacataaactagagtatgatatataatcagcactaactggccggaaaacggccgaaggaagcctcgaaaagtcgattcgtgttggacccatttgctgaacaaagtggttcattgcctacctattatggtagtagtcgtgataatcgtgtggttggttttgtcaacggtgcatttgcattttcatgacaataaaccttgcgttttcgttctcgggatattactttccctccacttctttcgcctcaatagctcctataagcattctcagggcgtatgtcggtgatcgagatttccaagcaagcttttagtggaaatcatcgcgcgcaagccagcggtaaagggaaaagaacggaggacgattacatacaagatgaacgaataaataaattaataataaataataataaaaagtacagtagcattaaatattattaagtttaatgattaaaaattggttaattgtcaagaaaatctaaggtattaataaataaataatactatgacaacttgcagcgaaagcatcagccccaatgaaaattaatcagaattgaatctgagcgtatttatttgataacggtttacgtaactgttggaataaaaatcaactatcatctactaactagtgtttacgttactagtatattatcatatacggtgttagaagatgacgcaaatgatgagaaatagtcatcgttttcaacggaagctgaaatacaaggattgataatgtaataggatcaatgaatatcaacatataaaacgatgataataatatttatagaattgtgtagaattgcagattcccttttatggattcctaaatcctcgagaagaacttctagtatatctacgtacctaatattattgccttattaaaaatggaatcccaacaattatctcaaaattcccccaattctcatcagtaacaccccaccccgtattacttttaccgtgatgaagattggcatcgttactttctaaacgtaggacgtgcggaatgacaaaaccatcagcagtgtcacgatctctccagtcacaatggcaatcatgagtgcatagtccaaagtaaaggggcaaggaaaagcatgattgaaaggactccccatctggactctatatgtcatcagcggctaaaaaaaagcatatagcacaacatcagcatcagcatcagcactagagtcatcggcccggcggtccgcggtcatccccgcggactttccgtccgcccggcgggctgtatcagcgtcaactggaacgcgcatatatatacaagacacacataacatagaagcacacccacgacaataaccacacgacaataaccacacccgcccacccctcctttccgtatacaatgccaaacttaaagagactacccatcccgccactgcaggacacgctcaaccgctacctggcacgcgtggaacccctgcaggacgagcgccaaaaccgccgtacgcgccgcactgtgctctccgcagaaaacctggacgcattgaacacgctgcacgagcggctgctagaatacgacgcacggctcgcggaaagcaacccagagtcctcatacatcgagcagttctggtatgacgcgtacttgctatatgatgcaactgtcgttctcaacgtcaacccgtacttccaactgcaggacgacccaaccatcaaagacacaccagagacggcggcacagggcccctatggcgcacacacggtgcaggttcgtcgtgccgcacgactcaccacctctattctcaagttcatccgccagattcgccacggcacactccgcacagacactgtgcgcggcaaaacgccgctgtcgatggaccagtatgagcggctattcggctccagtagaatccctccgggtcccggcgagccctcttgccacttgcaaacagacgccacgtcgcatcacgtggtggcgatgtatcgtggccagttctactggttcgacgtgctggacacacgcaacgagcccatcttcgccaccccagaacaactggagtggaacctctactcgatcatcatggacgcggaatccgccggaagcggatccgcgccctttggcgtgttcaccacagagtcgcgccgggtgtggtccaacatcagggactatctgttccatgcggacgactgcaccaactggcgcaatctcaagctgatcgactccgcgctgttcgtggtctgtctcgacgacgtggcgtttgccgccgatcagcaggacgagctcacgcgttcgatgctgtgcgggacttctaccatcaatctcgacccgcaccaacaccagccgccattgaacgtgcagacaggcacctgtctcaaccgctggtacgacaagttacaactgatcgtgaccaagaacggtaaggcgggcatcaacttcgaacacaccggtgtggacggccacactgtgctgcggctcgccacagacatctacacagactcgatcctgagcttcgcacgcggtgtcaccaagaacgtcgtcgacatctttagcgacgacgatggaaaaccatcgtcgtcgtcgttggcctcggcggctcactccgccaacttgatcaccatccctcgtaaactggaatggcgcactgacaatttcctgcaatcgtcgctgcactttgccgagacgcgcatctcggacttgatctcgcaatacgagtttgttaatcttgacttctccaactacggcgcgtcccatatcaagacagtgttcaagtgctcgccagacgccttcgtgcagcaggtgttccaggtcgcatacttcgcgttgtacggtcgcttcgagaccgtgtacgagcctgccatgaccaaggcgttccaaaacggccgcacagaggccatccgctccgtcacgggccaatcgaagctctttgtcaagtcactactggaccaggatgcctcggacgccaccaaaattcagctcttgcacgacgcctgtacggcgcactcgcaaatcacaagggaatgctcccaggggctcggccaggaccgtcacttgtatgcgctctactgcctctggaaccaatggtacaaggacaagttggagctcccacccatcttccgcgacaagtcctggactaccatgcagaacaacgtcttgagcacctccaactgcggtaacccctgcctcaagagcttcgggttcgggcctgtcaccgccaacggcttcggcatcggctacatcatcagagaccactccgtctctgtggtggtgtcctcaaggcatcgccagactgctcggtttgcgtcgctcatggaaaagtcgctgctggagatcgaccgcatcttcaaacggcagcaagctcgcgcagcaaaacccgctgccaggaccactgctagcgccaacaccaaatcagaagacatgaaatacctgttgtccggctacgattacttcgacgtgagcgtgtccggttgagtttatgctgagtttttgcgcatcaatattatttttactactactactactactactactactacatactattaaatatactaaataagaggaaaacgctttggaagtgactggcgccgccgctggctactataatagcagcgactgtaatttaatctcatcccgtcgtttggattacctcttttactcgccgagcgaacgtgcaccaaaaagggaaaggaaaaaaagaaaaaaaaaggaaaaaggaaactcaaaacttggataaatagaagcactcaaactaaattaaactgccaaaaaaaaaaaaaataaaaagggaaaagtttaaacatcaaagtacacctttcacccctccacacaccatggaacaacctgatctatcgtctgtggccatcagtaagccgctgctgaagttgaaacttctcgacgcccttcgccagggaagtttccccaacctacaagatctcctaaagaaacaattccagccgctagacgacccaaacgtccaacaagtgctccatctcatgctccactatgccgtgcaagtcgcccccatggctgtcataaaggaaatcgtccatcattgggtctcaactacaaacaccacttttctaaacatccatcttgatctaaacgaacgggactccaacggcaacaccccattgcacatcgccgcctaccagtcccgcggtgatatcgtagccttcctcctggaccaaccaaccatcaacgactgcgtgctcaacaactcccacttgcaggccatcgaaatgtgcaagaacctaaacatcgcgcagatgatgcaggtgaaacgctccacatacgttgcagagaccgcccaggaattcagaacagcttttaacaacagggacttcggccacctagaatctatcctctccagccctcgaaacgcagaactgctcgacatcaacggtatggacccggagactggcgataccgttctgcacgaattcgtcaagaaaagagacgtcatcatgtgccgttggttgcttgaacacggtgctgaccccttcaagagagaccgcaaggcaaactgcccatcgagctcgttaggaaagtcaatgaaaacgacaccgccaccagcaccaagatcgccatcgacatcgaactgaaaaaactattggaaagggccaccagggagcaaagtgtcatcgacgtcacaaacaacaacttgcacgaggcccccacttacaaaggctacctgaaaaaatggaccaacttcgctcaaggctacaaattgcgttggttcatccttagtagcgatgggaaactatcctactacatcgatcaggccgacactaagaatgcctgcaggggctccctaaacatgtcttcgtgctctctgcatttggattcgtctgaaaagttgaaattcgaaattatcggcggtaacaacggtgttatcaggtggcatttaaaggggaaccaccccatcgagacaaatagatgggtttgggccatccagggcgccataagatacgcaaaggacagagaaattttgctgcacaatggcccctattcgccttctctggccttaagccatggcttgtcatccaaagtgtccaataaagaaaacttgcatgcaacttcaaaacggttgaccaagagcccgcatctgtccaaatccacactgacacaaaacgatcacgataatgacgatgacagcactaacaacaacaacaacaaaagtaataatgattatgacgataataataataataataataatgacgatgatgattatgatgatgatgatgaaagtagacccctcatagaaccattaccgttgatttcatccagaagccaaagcttaagcgaaatcactcccggtccacattctaggaagtctacagtctcgtctacaagggcagccgatataccatcagatgatgagggttactctgaggacgattctgatgacgacggtaactcctcttacacaatggaaaacggcggtgaaaacgatggcgacgaagatctaaatgccatttatggtccctatattcaaaaactacacatgctacaaagatccatttccatcgagttggcatctttgaacgaattgctgcaagataaacaacaacacgatgagtactggaacaccgtcaacacttctattgaaaccgtcagcgaatttttcgacaaattaaatcggttgacctctcaaagggaaaaaagaatgattgcccaaatgaccaagcaacgggatgttaacaatgtttggattcaatcggtaaaagatctggaaatggaactggttgataaagacgaaaaattggttgccttggataaagaacggaaaaatctgaaaaaaatgcttcaaaaaaaattgaacaatcaaccacaggttgaaactgaggctaatgaagaatccgatgatgcaaattcaatgataaaaggatcccaagaatcaacaaatacccttgaggaaatcgtaaaatttatcgaagcaacaaaggaaagtgatgaggattctgacgccgacgaatttttcgacgcagaagaagctgcttccgacaaaaaagccaatgattcggaagacttaaccacaaacaaggagactccagctaatgcgaaaccacaagaagaagctcctgaagacgagagccttattgtgatcagttctccacaggtggaaaagaagaaccaactattaaaagagggatcattcgtcggatatgaagacccagtgagaaccaaactggctttagacgaagataatcgtcccaagattggtctctggtctgttttaaagtctatggtcggtcaagacttaaccaaactaactctaccggtatcgttcaatgagccaacatccttactacagagagtatctgaagatattgagtattctcatattcttgaccaagctgccacttttgaagactcctctttaagaatgctatatgtagctgcctttactgcatcaatgtacgcatctaccactaacagagtgtctaaaccattcaaccccttactcggtgaaacttttgaatatgccagaactgatggtcagtaccgattcttcaccgaacaagtctctcaccacccacctatctctgctacttggacagaatcgcccaaatgggatttttacggtgaatgtaatgttgattcgtcattcaatgggcgcacgttcgccgtgcaacatttaggattatggtacattactatccggcctgatcataatattagtgttcccgaggaaacttattcctggaaaaaaccaaataacactgttatcggtattttaatggggaaaccacaagtagacaacagtggggacgtcaaagtcacaaaccataccacaggcgactattgtatgctgcattacaaagcccatggctggacctcagccggtgcatatgaagtcagaggtgaagtattcaacaaggacgataaaaaattatgggttcttggtgggcattggaatgattccatttacgggaaaaaagtaactgctagaggcggagaactgacattagacagaataaaaacggcaaattctgccacgggaggaccaaaactagatgggtctaagtttctgatatggaaagcaaatgaaaggccttcagtgccatttaatttaacgtcgtttgcattgactttgaatgctttgccaccccacttgataccatatttagcacccacagatagtcgtttaaggcccgatcaaagggctatggaaaatggtgaatacgataaagctgccgcggaaaagcatcgtgttgaagtaaaacaaagggcagcaaaaaaagaaagggaacaaaaaggagaagaatacagacctaagtggtttgtccaggaggagcaccccgttaccaaaagtctatactggaaatttaatggagagtattggaacaaaagaaaaaatcatgactttaaagattgtgctgatattttctaagctgtgcaatgtagtcacaataacactcgttcatttgtatccattgcgaatgccggtacatcggaaaacaggataggacctatttaattatatagtatgaagtattcataacttcttgaggcatcaatacatcatattccatgagctgcgtggcattcatactcattgatttaaaggttttttattttcatggaaaagattaaccgggctgaacgaaatatattaaagatgctaaaacttatgctttcattgactttcaatagtgtccactaaccaaaaaaaaaaactactctaacaagggatccccatggattcaaagccgataccaaacagatattactctgcatagaattcaaaatattatccatataaagatgggaaagaattccaaaaggaaaattctgctctagaaggtcacaaaactagtaagaagttgacccccctgccattaaaaaacgtttttaacagctctagcaatattctaatttcgaaagtgctctcaaaagaatttattcatttgcgaaaaaaagaatatctcaaaattttctcgatcacgtacaacatcgtagtatttaaaggattattaagtcaacgaataatttccacaagaaaggtacctctagttttggtgatgaagcaagacaataactggcaagggctctcactaaatatcaacccctttcaaataaaaaaaggatcatggctggcagcgcccacaacaattaaactctgttactatcaaaaaacattgagcccaagaatggaataaaattttcactacacctcggacatggatttgtacatgtcctattatcctgtaattttgacatatactgatatggacctcttgtttcgtataaatcgctatttatttccccagataactaaagaaaatccttcaacccagcgttctatattactatattctcaacccgccgttttcctgctgtgcgataattctcattcaatactaccatttcaaacctagaaaagggtgtctttattaaaactgtaagaaaattttatcatgaactctgatgaaaagtcttcggaagatcaactttttgatttttcaaaaatgaaagaaactgttgtctccatttatggcctcatatctgaaggaaattcgtctgctattagtcataccactatcttcttcttgaagctgcatttcaaggttgattaggaagcatctaacaatcattcgatagggaaaacagaaaggccgttacagttttttaaaaatatcaatatcaagagaaagaactagggatattgcaaaatcaaaacttctgatatttggttttacgtgaaaattaccaacacttaaacgttaaaatttcaaactatctactgaaatataaattttcagtcaaagagatgaaacgattattttcttgagtaattcgttgtcacaatttaacagaaaattactgtttttttcaagtagttcacaaagatactcaaactaagatcatggagacgtcggcaagcaattgattgttagtgattatcaaaactcattagcttcggtaaaactacatagattgaaaatcagtagtaacatacaacatggtttccatgagattacaaaccggccaacctaatgctttcaaaaattctttgcttactgattcacggtggccaagaagcatataaatctgtactttgcagtaaaaaacagatggtattgctcattcccagcgattgccaaatacgattcataacagattgacttatctttttcgaaagctctatcatatggctttgagtaataaggtgagatttttttggtgatgaaaataaatacggtgccttgatgcaaaatttttagccacaaacctctcttcagtcccacatgattcacctgattacgactcactatttcatctgttccataaatctcggctttttatatacagaacattagacgacgggaagagaaaaacgtcagtataacccacttttgttcgtaaaaaaaggttattcacttctactccgtactaatcaatgactttaatggtgaaaccatgatgaggagagtaacacgatgtaattgtcataaactaatattatcccatattagtttactgacggctacaagtgagaatatatactttaagagtgtaaccataccagtaattgggttccaaacaagtttgtgaggcgcgtgtgctgaaagtaaaaaaaacttaccttaataacgcaatttctggcgaggttaaaatattaaatataaaaagccttccaagtaattttgcccactaaaatgtaacacaaagctccactggttctcggcttcttgttctttcaaaaggatcttcaaatccgcttccacttaagcagccttctgctacgacttcttctgagacactcggtttcgcgcgggcacttctgcccaccaaaaaagtttattttccggaaagcttatttctaaataaacttctgaggaattttttttccgcaaatttccatgcaacgtcgaactctcaaattctcacgagattatttgacttgctttcctttccccctttttccacgcactacgtcaatgcaagtgatccgcttttgaagaagcaaaaaatacttctttcagctcgtaccggcatttttattatttgtcaaaactggcgtttggaaaccagctcttcactttttcttcgtggtttcttcgtggttttttcgagagttttgtttaagccccttttatggatgcatgagaaaaaaaaaaggtttgctacaaccatctcaggtctcttgaaggatagttcgaagctcgcctgaccgtctttgggtgaccaggcttggttttcagttttttttagctcattgagatatgtgatcccgttcctagatattatgagggaattttatatatcaaattgattttcaccgcgaattccagaaggatgggcaaaagagggcttgttggcgtgggaggatggtcgcggctgaaaattttcaccacgagcagtttcttgtgagacatcctaatacttttgcatttttaccaagcagtcgtccgtagcaaagcataggttagtaataacaatgtgcaaataaaaaactatcttacaggcaattattttgtggcaaagcaaggtccatgttttcttgaaaggtaagaagtggctttgggacagctcatatagacagatttaagtttttgatctgagaagcgaatgaaatgtcttcagtatcattcaatttagcatccttttcattgactttgaatgttttaccgccccaatcaatgccataattagcaccccatggatggtcgtttaaggcctgaagagttatggagcattgtgaataaaataaaaaattacttaggaaaagcatcgtgttgaagtaaagcaaagagcagcaaaaaataaatggagtaaatatgagagaaatacagatcagaatggttcgttcaagagtccatactataaacccgatggtgacttttgcacaaaaaaacaatggtttcgaagattgtgctcatattttctgagctcaacatatgctcgcaaaaacacctactaattgatgtttaccaagaacgcgagtacagtcatatatagatgtagtagagttgagatattctgaatcggaagtacgatatttcaattcctatattgcaaaaatttatatatttggagcttcttgaaagaaaaagtgtccaacatcctgcatgaagtttgatcactttagctggtcccattcgaagaacctttttttttttttttttttttgagattcttcatattctgttattaaatttttagactttaatttttactttctatgtaacgttcactcttaccctaaatattaaactatttgataaaatattacactgaaaggtgttacaacttttcctagaccaaccttaatataaacgttacgatataaaataaacagtaattttaagattccattgttgaatgtgacacgtaactctaggccatacctggtttagtattttttaaaagaactcttgctacagcatattttacgtttgcataaaaataaaagaaaagcttccttatgaaacactggttaagaaaagaaaatggagtggttacatactccaaaataaattactcttaatatctgtttatccaatgaggagcagatctcaaagataatcagacttgttattgaagcaattgaagtaagtcttccattgaaatcacgctaattattaagcaatatggtggattaaacaactctgacgggaccgtactacttgatgaaaagttatatacaatattgaataacagcataatgctgtatgatgttgagcggaagattgtataaaaatgtccttttctaaaatcatgaaaaacgaaccctttaaagtaattttgtagcgaaatttaacctcacgagttcatgatcataactcgttatcatttttgtaatattgaatcggtctctatagagcctcatgagaagatagaggacccgaaataattctcccttcaaacattatggccaataagtgtcaggaagtgaagcattgacatgacagcagcacattaaaactctattgaatataaatacgatccacgacatgtcgtttacaaagcgctaaaaactcatgagccaactattccctaaatttccaagatctatcatatatttttccctaattttccaagaggaacctccataaaataatgcagaaaaacatttgtttgatctattttaaaaggcatatcgcatgttatagtgaatctgaagattgcttctctcgtcagtattaatgcactatattacgtttcaaataattcgtagattgtctcaagttttcagtatatttgccttcatgacccaccggtcctcttccctcaagtgctcaacgatgggagcttcagaaaaatccagcagcatagttgagttctgattctctccttggtagttttttcctttggtgatttcggattcataatgaaaatgtttcgtatattctatgactaaagttgttattgttgtaagtatttctgcttcctcttgcaacaattccgctcccacttataatgcaccgaggtgaattggtcatccttacgaaaatacccagatagaaatggagtagttgcgtgatcgtttactgcatcttttgcgccttttaatcaatcttgacgtggatatcttgttttgcttgaaccaccacctgtattgctggtataaatcaccatattaaccatcgttttcaatcaacgcaacttttagtgtattgtctgcaacatctgatttccctctggtaagtcacctaatctaaaatctctattttgaatccacggagacatacgtttgaaagatataaaagagttcattgaaaagtctagcgtcacaactgacattaaaatacttaaatatgaaccaaaattttttggcttttattttcaatgcaatcattatctgcctatacaggaaacgctttatttggctcaataatatgatcatgtttgtctgaagttggcaataaaagaaactaagaagagccactaaacttattttatgatatgggaaacacagaaaacactccaaaaattttggtacaagaacctgaaaatagaacaaagaaagaggcgaggtttggtacatctaatttacgtgacctagacgttgctcaccttatgttaatagcttatcagaattacaagtaattacttgtaggaacatcctctactagtgaatatgaaagagcagaggttagctccgtctcaaccaattttgtacaagtcgttgaaaaggacggctctactgtagacaggtcgattcaaagtctggtctcaaaatagaaggtaaaatattattgaacaaaagaccactaaaaggctatggtatgtccaataagatgcaaaatagacatttcactcgctaatcgttagtgggattatatcttactatactccttatctcattgaatggcactagtcgatcgaggaacaaaaaaggatcgaaccgattagcacggatttccttaagtaatttaaattaccaaagaagatccacatcagcagtcgaatgttcaagatgccgtaagtttaaaatctttcgtatctttccccgatcctgtctttcatcaatgaacttgaatatcaagagtgaaaaaaactcatatggcttctcttgaagagttagaaagataggcacatgccaattgtgtgcatagcacttactactcaacgatttcacaacctagcataatacgcgaaaaaaaaagtgcatttatttaggtaagtctcattacctaaacgccagtttgtttcacgtaattggtaacgatgagggaaccgcagtagaaaaaactttcattcacaaacgattaaagtgttatgctagccagtttcaggctttttgttttatgcaagagaacattcgactagatgtccagttaagtgtgcgtcacttttcctacggtgcctcgcacatgaatgttatccggcgcacgatacttatcaccgaaaaaccttattctacggaaaaccttatttacattaaagttggaaaaatttcctctttttcctaataaggtggagcttttggcttccagtatgctttcacggaattatttctcatgtacatttagctccatttccagtgcctccgatagggaggcatcatggtactaccgtgacggagaatacgtaggctgactttttcgtcagtttgttgtccgtttacaaaattggtgaatgaattctagccttcctctgctcattaattgccctcacaagaatttggaagtgcgtagacaggtaaaagattgtactacagaggtattgtggaaccttctacagtacttcggaatacacctaaaaggttgttggatgctaaatttagcaaaagtcttttttagctcactattaggcttgttaaagtctgaaattgttgaaaggcactcaaaaagataaatcaacaatcagcattaacggcacagttgaaagagtcacccacttgaaattagctcggttatcaaatataattatctctggtaaagagctctgcagcagggttaatctattcgcatacttacgctgtaggaacattttattattaggatccgactactgcctacatatttattcggaaggcatgatgtcgaaaatttttgagcttataaaaggaacatatttcactcttgctcgttgatgtaagctctcttccgggttcttatttttaattcttgtcaccagtaaacagaacatccaaaaatgacaatgcctcatcgctatatgtttttggcagtctttacacttctggcactaactagtgtggcctcaggagccacagaggcgtgcttaccagcaggccagaggaaaagtgggatgaatataaatttttaccagtattcattgaaagattcctccacatattcgaatgcagcatatatggcttatggatatgcctcaaaaaccaaactaggttctgtcggaggacaaactgatatctcgattgattataatattccctgtgttagttcatcaggcacatttccttgtcctcaagaagattcctatggaaactggggatgcaaaggaatgggtgcttgttctaatagtcaaggaattgcatactggagtactgatttatttggtttctatactaccccaacaaacgtaaccctagaaatgacaggttattttttaccaccacagacgggttcttacacattcaagtttgctacagttgacgactctgcaattctatcagtaggtggtgcaaccgcgttcaactgttgtgctcaacagcaaccgcctatcacatcaacgaactttaccattgacggtatcaagccatggggtggaagtttgccacctaatatcgaaggaaccgtctatatgtacgctggctactattatccaatgaaggttgtttactcgaacgctgtttcttggggtacacttccaattagtgtgacacttccagatggtaccactgtaagtgatgacttcgaagggtacgtctattcctttgacgatgacctaagtcaatctaactgtactgtccctgacccttcaaattatgctgtcagtaccactacaactacaacggaaccatggaccggtactttcacttctacatctactgaaatgaccaccgtcaccggtaccaacggcgttccaactgacgaaaccgtcattgtcatcagaactccaacaactgctagcaccatcataactacaactgagccatggaacagcacttttacctctacttctaccgaattgaccacagtcactggcaccaatggtgtacgaactgacgaaaccatcattgtaatcagaacaccaacaacagccactactgccataactacaactgagccatggaacagcacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacttctaccgaattgaccacagtcaccggtaccaatggtttgccaactgatgagaccatcattgtcatcagaacaccaacaacagccactactgccatgactacaactcagccatggaacgacacttttacctctacatccactgaaatcaccaccgtcaccggtaccaatggtttgccaactgatgagaccatcattgtcatcagaacaccaacaacagccactactgccatgactacacctcagccatggaacgacacttttacctctacatccactgaaatgaccaccgtcaccggtaccaacggtttgccaactgatgaaaccatcattgtcatcagaacaccaacaacagccactactgccataactacaactgagccatggaacagcacttttacctctacatccactgaaatgaccaccgtcaccggtaccaacggtttgccaactgatgaaaccatcattgtcatcagaacaccaacaacagccactactgccataactacaactcagccatggaacgacacttttacctctacatccactgaaatgaccaccgtcaccggtaccaacggtttgccaactgatgaaaccatcattgtcatcagaacaccaacaacagccactactgccatgactacaactcagccatggaacgacacttttacctctacatccactgaaatcaccaccgtcaccggtaccaccggtttgccaactgatgagaccatcattgtcatcagaacaccaacaacagccactactgccatgactacaactcagccatggaacgacacttttacctctacatccactgaaatgaccaccgtcaccggtaccaacggcgttccaactgacgaaaccgtcattgtcatcagaactccaactagtgaaggtctaatcagcaccaccactgaaccatggactggtactttcacctctacatccactgagatgaccaccgtcaccggtactaacggtcaaccaactgacgaaaccgtgattgttatcagaactccaaccagtgaaggtttggttacaaccaccactgaaccatggactggtacttttacttctacatctactgaaatgaccaccattactggaaccaacggcgttccaactgacgaaaccgtcattgtcatcagaactccaaccagtgaaggtctaatcagcaccaccactgaaccatggactggtacttttacttctacatctactgaaatgaccaccattactggaaccaatggtcaaccaactgacgaaaccgttattgttatcagaactccaactagtgaaggtctaatcagcactacaacggaaccatggaccggtactttcacttctacatctactgaaatgacgcacgtcaccggtaccaacggcgttccaactgacgaaaccgtcattgtcatcagaactccaaccagtgaaggtctaatcagcaccaccactgaaccatggactggcactttcacttcgacttccactgaggttaccaccatcactggaaccaacggtcaaccaactgacgaaactgtgattgttatcagaactccaaccagtgaaggtctaatcagcaccaccactgaaccatggactggtactttcacttctacatctactgaaatgaccaccgtcaccggtactaacggtcaaccaactgacgaaaccgtgattgttatcagaactccaaccagtgaaggtttggttacaaccaccactgaaccatggactggtacttttacttcgacttccactgaaatgtctactgtcactggaaccaatggcttgccaactgatgaaactgtcattgttgtcaaaactccaactactgccatctcatccagtttgtcatcatcatcttcaggacaaatcaccagctctatcacgtcttcgcgtccaattattaccccattctatcctagcaatggaacttctgtgatttcttcctcagtaatttcttcctcagtcacttcttctctattcacttcttctccagtcatttcttcctcagtcatttcttcttctacaacaacctccacttctatattttctgaatcatctaaatcatccgtcattccaaccagtagttccacctctggttcttctgagagcgaaacgagttcagctggttctgtctcttcttcctcttttatctcttctgaatcatcaaaatctcctacatattcttcttcatcattaccacttgttaccagtgcgacaacaagccaggaaactgcttcttcattaccacctgctaccactacaaaaacgagcgaacaaaccactttggttaccgtgacatcctgcgagtctcatgtgtgcactgaatccatctcccctgcgattgtttccacagctactgttactgttagcggcgtcacaacagagtataccacatggtgccctatttctactacagagacaacaaagcaaaccaaagggacaacagagcaaaccacagaaacaacaaaacaaaccacggtagttacaatttcttcttgtgaatctgacgtatgctctaagactgcttctccagccattgtatctacaagcactgctactattaacggcgttactacagaatacacaacatggtgtcctatttccaccacagaatcgaggcaacaaacaacgctagttactgttacttcctgcgaatctggtgtgtgttccgaaactgcttcacctgccattgtttcgacggccacggctactgtgaatgatgttgttacggtctatcctacatggaggccacagactgcgaatgaagagtctgtcagctctaaaatgaacagtgctaccggtgagacaacaaccaatactttagctgctgaaacgactaccaatactgtagctgctgagacgattaccaatactggagctgctgagacgaaaacagtagtcacctcttcgctttcaagatctaatcacgctgaaacacagacggcttccgcgaccgatgtgattggtcacagcagtagtgttgtttctgtatccgaaactggcaacaccaagagtctaacaagttccgggttgagtactatgtcgcaacagcctcgtagcacaccagcaagcagcatggtaggatatagtacagcttctttagaaatttcaacgtatgctggcagtgccaacagcttactggccggtagtggtttaagtgtcttcattgcgtccttattgctggcaattatttaataaaattcgcgttctttttacgtatctgtgtatcttttctttgctaattatacgctgacatgaattattttttaactgtttctcctccatactttcaaatattcaaattgactaaatgataattcttgcgcttcttattttgaaaaagtagatatgtgtatcataaagaaaacgttattattattgtcttaggcaacaaaaatccatgaaaagaattttaccgttatcgatatcattgtatttattttatttatttattcaatttttttttttttggtttatatcctgcaaacaacacttcgaattcaattcgatatttcataagttacaactaacacttatagaaaccgatgtatgagtacttattattaacgaggaaaaatgccctattttctttagcaattaatgaaccatcgccaacttttgctttaacaattattgccattttcagcagtactaacgtaagatctagtgtggttcgcttaggatgttttcgagtagaaatctgctgcacatgccacacgcagtacttgaaacttgaaataatggtgataattagttatttaaagtatgttaatcttccttgttcttttatatttatttcgaattcttttgcactagtatttaaaatatcagcagaggtgtaaaagtgcaccaaaattattgtaaaactacttgccctaaaattgatacttcatacttgacatattcaaaaggggtccaagtatagatgcatcaaaaaaaaaaattatccgatgatgagcaaatggtagcttttcgttcccaggaagtgtagtagttccatgaagtctaatgagactttggaaaaaggtttgtcacgagcacctaactattgtattttggaattttgataaacttcaaaacgggaacgaagtgttaaacttagatgcggttgatttaagctttaaaagaggaaaataatgactgatgataagaagtcaacaacgattcaaagcaggtgaatttccattacgtttcgcttttcaattgaaaaaaatttggtggttattcatttcttgcttgacctctttactttttatacttctgtgatgagaagcaagttcgaggattttacgataaagcctactggttatatttgtataaattagaacgttgtccttatttctcttttcgaacagtatcaaaataaagtttttgattagggccagattctcttcaaggaagagatacctcacgtctgtaatatctaagagctaatgtttcgatcgaactttcctttgctttttttctggatctcataatgtcccactgtatgtatgtgccctcgcacagctttgctcatcatagacattaatcattggttgtacgataaaaatatcgcaaaaattattctaacgttcagattagattccggccatatttctgacatttgttttattaataaaaatttggcgaatgttttgataacttgataactgctgatatttcattgttgaaaaggcatgatattagatgcacaaagtatattataacttattatcagagatataggaacaaaaaaaaagggaaattcatatctatatgtgaaaataccattatttcctcttctatttaatatactgtccttaattttcatattacattatcaacttttgcatttcagtgtccattaaatcttgggaccattttctcaatcttcatgtcgtgttttcacaccgtatataatatactggtaatataagtactagtcgatagatcgcagttgagtcttatcccaacagttaatgattcactgtgctttctgttgctgtagaatttctgaggcattgtcgctctcttctatgtgatgctacaacggaactaggcttcttatatatcgtggtcctacaagatcttggtatctcgtttgcttactttgaagcttcactgatatatagtatttaagccactttcatgttcatggataatcgtaattgtactacgctggtaccagttatgaaccctatcaaatcatcattgaacactgctatttttaactaatcaagatgtgtatgcggcgtactttataatttcacgacactattgaaagcaaactaaaaatcaagtaaatacctatccaagttgcgggctctggatttatgtggccttaaattttcgacctatggttcgctattcaatatgagaaaaccaaaattaggtacaagtactgattacgtccgtgattcgaaaagcagcgttgaaagattacaagattttgcgtgtccaggccgacacttaactttaaggtctcgacttagtaacatgagttgccaaaagtttttttctcctatctgaatatggggaaccggaatttgtctttgacctgactttcaaattgttgcatatgtaaaaaaaaacagaagaaatatgatcttcttcttctagcgatgcaaaaggattcattacaaatcgtcgcaaaggccgacaagttgcagtatattcacattgcttatttgaagtatgtttgtatacacatcgatagtattcattaacaccacaactgctgtgtatactatgtcaaacagcataataaagcccgtcatttttgtacccgctcatttccaataggcatctaaacttacaaatgtggtacactacttcgaattcattaatcgatattgaatgctaaaagtctgcgatttcttcctcaacgttcaaaaatctcatccaaggcataatcccacatattgaagatcgctaccaattgttacgggcgaactgaggttttggaaatgagcttgtacttagtaaatttctctttgcttgcatcttttttcttccttgccaaaaaataaaagatactcattttaaaagcgcagccatattgactaagtaagtaatcataatactatgagtaatttttgagtactgtgctcatttactagctgcttttctgagaaagatcctcgataatcaattccaggttagtggggcccttctacggcttcttctaaccaattgttccccgtgagttgctttctccgaaaaccttattatacattagagttataagaaaattttctttttcccgtagattaacctgcagtgccgaacttctagatgtcacaccagaccgtttgacaccgccattttccttccttttcggaaaaatgtgccgataaatggtaagacgcgacgccactgctacgaatattacgcttatgatgaagcaaaaggaaaaagcaagttccccttaaattcgtataactgtttcatcaatctttagttctggcatttgaaagttaattaaacttttcttcgtggtttctacaggagttctgcatgtgcgtaattcaaagcctgtgaaggaaaaagtattgtcctaaacaacggtcgtagaatacgtcaactgtagtttaaaatattttctggctctactcggtgcgataggtctggctcttttctatttacttttgtttggagttgttgaggccgatacccgtctagatgtaaatatgaaataacagttcgaggttttattacgagaatgaaaagggtaatggattggagcatgtgtaaatgtcaatagcagaaaaaatttaccgcaaattgtttcgtagtcttatcttcatcggacactcaagggttgcataatttttacccaaaggaacagtatacttttttgataaaaaaatcttgttacctatacagtattgcaagcattttcagaaactcgtcttttgagttctaaatgcatcatacaacaacaacaacaatttcttattactgtgtccttttgggatttttcagccttcctagcttacccaaaatagcctctcaaggtgaaaaaaccatgcctgcaagcggatctaaggatgagtagctagattacaataaatcctgaattttctctgagtgtcaactttgtcatcgcttgttaaagggctactacgctgaaaaagaacctgaactctgttaataggttgaagattttatgacttggtatactattccatacggctgctctcctgattgcggtgggtcattgctataacagtaaaatcaaggaagataacaggaagagtaactttagtacaataaatctgttgtcttcccgaggattataattgttcggctttcacactaagttgaaaagggggactcaggaaatgacagggtacgttttagtttctccaaataaatcttccacacccagcttcaatgtggtaaacgggggaaagttgattaattgatgttggcacttatatttaactgatgtagagaagaacaacatactactaacgtcacagtcaattgtgccagttttccaatcaagtatttcgagataatgtaaaagtaattgatatatgttcgtactggtttcccaatttccgggaaaaactatgtacatgggtgcaattccttgtggttatttccttttaggttatattgccaaccacatcatagtactatttgcggtcacttcagaagatatgtttgctcctttgatcatgatatagaccaggccaactgtaccgcttcaggcttcaaagcattaggaataagcaccactattacacaaccatagagctactcttactgtcacgtaggtaaaacacttgctactacacacactcgtagtgactcatctgactatattgccggttgttaagaggcaccagttaagcacgccatcaagggtaccgaataatctcttctgtatcaagtattctacctttatgtctgacccacgtattatgtggagcaattacgtatttttctcatatcagctttgtttttactcaactttgatatcttagagaaacagatcttgatgttacagcaaggtcaggaaaatattttgacaaaaacatactagtttcatccttagtagttgattctatgaatgctgtacttgaaaatattgttcataaaatccataagttttaccaacggtataatatcctgctattaaatctgcaattgcttttgcgaaaagaaggaaaacatgcaaaacaaaagcaaaaaaaaattggcaccccaatttcttataatataataatataacggaagtacaccatgctttcaataataagatgtttcctgaaaagggcaactatctgactagttcagagccatgcaaaagttaaggatgaaaatgccaaataagaagatattacggagtacattcatttcaaaaagaagaatgtatactgcttagataagaagatcaagtttttatatttccgaccaaataagccatcgaaaacttttgatgcaccaaacaccgttcttgagagccaagcacagatgcaattgttctgcccttcttccaaattatgaattgtgcatcatatcgtaaggccagccacataaaaaaaaggagcaaaaaactcagtatacaggcgaatatccatcatacagtctagctgccctcactacttccaaaaaaatgggctagtgttgtacggtttatgccatatatctagagttagcataactatgcactaccgcttttcgaacaaaaagtttgcgaaacctagttcattgaatatgacttacccaaaatggataccaagatcctaataataaagtcaataacttgaattttaggtgccattatttccaacaatcattataggctaactctaccagcagacaagaataccgttcttctagttgagcacatggtcaaaatagtcaataaaaaacgcccagaaatggctgtaaattagtgtttgtagtacacaaaataatttcctaattccttccaaatggggttttcaaaaagctgactcacgtaattgatcaatacttcactaaagaagaatcatatgaataaaactaaaatcaacactaactgagagacttagcggccaaagcttaatcatcattacatagagtatatgaagggagtaagtgaatatgcaagggtgggaaacggcaaagcatttttatgcaaaaagcgtatttacaaatcccgtaaactcatgatgtgaattttgtaaccagctttagctgagattatttcttttgcaaaagaaatattcaataaattaacaattttcaaataaattacccatccatggtcgataacttgcaagagagatatcatcatttggcttttgtgataaatttacaaaacgtaatgttgtatcgagatatattgagttacaagttttcgtctctttttccgaagcgccagactcccgtataaaaaataaggtttatagcgggcattatgcgtagatcaggacttaaatttttcattgcagaagtccaatttcagactcagtatggtttgttgtagtgctggtgtaaaagatggtgttattacttaagactgatttggttgctcaggtatttcattcaataaaattgtgaaagagaacctggaatatagaatggaaatatatatcctgctactaaccccaatggaaggtgacgatcacttcttgtgcgttccaatcccagtttttgaatgtgcgagtggaaaaattctagaggaacaaattgatattttcaaatcagaattcatcaaatatatgtactctgtaaaaaccaaggatgtgatgaagttgagatattgtctttatgggaaattgacttctttgtttaatatgaataatgcaattttactcctcagctcaagtagtgtaaagattcagtagccgtcatcaaatagactaaaaattaaaaaataagattcaatgtggtatgataatgatagatgagaagaaattgcaagaaaacgaataaataccttgtctctttgcactgaatatcttaaaggacatacagtcgcaataacgtctactcattggtgtgtgtcaaaaacagtacgtttattatctggacagccaaaaaataagatctattcaaacatggaatatagcgtatttttatttaatcacggtacaatggagatatttgcatgcctatagaaacaagtaatagttatcatattattttctagattttgtcactgaacttttccactaatgaatcctatcaaaattatatatccaatatggctgcattcccaactaaatattaaaatgccgctaagtataaaatgtctccgcatcggtaaaaagcattacaaatgcgtattatactagcgagaaaaaagtataagtatcaatgccaatcaccctctgaccataaactttctaaacatgaataataaaggtgttgagagttattatcctaattgatcaattaatttgaagcaaagttattatgttaaagaaaaagggatgtcacaatcctaactataatttttgcactatactctgtaggcgtacaaaatggtttgtaccgactatattctctttatttttgacaatcctttacgatatatgattaagaataccatgttatttttatgaaaatctgtgatttttttgttttcatacactttttatttttgtcacgtagtgcactttgattaatacaaaaaaaaatgctgcaaaagcatcgactacataaattcattaggacgcattcctcattaccacctgggtctaatttttattttgaaattgatattattctttatatgatgaggtaaaaagcattatattcgttgtaaactcatatacttatcctcattttaggcaccatcagggactaagggctaaagtatcagagccgcatttcaacagtgtacagagattttagaaacattatcacgcactgccttttgctttgtttacccgtaatgagtatacagtggattttctggtgctaaagcatattgccctttcggcaatacttgatgccctaaacattttcatcctggaacatacgagtaagagcacatttatgtgcctatattcctcgttttttactggtgctgaatttcttattttccacagataacaatcatgttaataaattatgcactgtgctaatttttcaattaaggttctattacccctctatcaccgacagaaacacgtaatgatgtgttatttccattataattccgtaagaatggtgtttataggtagtctaaagaacgtgcatcagagaagaataactgtcgcaaaaaatgactattctttaccttttcaaacttaactgagatagttatctctattattaccagtggcacacacgcgaactacatcactcaccactatcgtcttaggaactcaagattttatagtaatgcagccgaagacattcaagtcctgagagaaaatgtagacattttaagaaaagtaccggaaataaagcacatgtaaagcattgagctctgtactctataaaaattagctgcattcaaacaacaatgtttgaaatttttgcaaaagttattgaaaaagattgctgttttcagccttgttcagatcatgtctcaaaaatgagaaactggaactctcataatcagtacctcgtatttttttttccttatagtttcgttattaaaaatttttttgctgctaatttaagtacgcttttggtcataaatgctacccaccagttgaattattgacatgattaaaatacatttcagaactttacggattaaaaactttaaagaacctttcaatccatgttgctggagggccatgaatccacgaattacagcaaaagaagacagtaactacttagggttcaataattacttgcataaacacacactaacaaccaaatcgtactaaaatttgcaattaacaaaactccatcatatcacgctgaattatgtagggcttcttaatgcaataggttgcctgaattttgcttactcgtgctgccgggaacacttagcagttgggaggccgtttctcccatatatttcataattttctgtccttcttagagtaggatgctgaaaatcaaaagaagaccgtcaataggaccagattttgtgggtcaattttgggccagacacatgataccctaggaagtttaacggtatacaactcaaggacgaggagtattcggaaactaccggtttttaacaagctgcaaatttccagtagctgttttggttgcgactacggataaaaattcatactttaggaagtgaagcaagataaaaaatcatgctgcatcctaattcgtgaagtttgttaggaatattattgtaaacaaggaaccgtttcagtaaacttgctctctactcttctaagctgtaatttaaaaaaagcgataaaacaatgattttgattatctgcaacttctggaaactcgagatactacgctagacgagatacctattaattgttttcctaaaaaatcaggaacagttcctggcagctttcggctccttcttgttctggaaaggatcttcaaatccgcttccacgtagcagtcctcgctacgacttcttctgaagtattttgatttttggctgcatttaccttttattgccgaaaatcttattttccaagaaaaaagcttattttgcattaagtttaaaaaatttcttctttcccgtagattgacttgcagcgtcaaaattccggaggcctcacgagattttttgacatcggtttttgacatctctttttccttcctttttctttcttttcctgcgcacgccgataaagaagtagtacaacagacaacgtcaaaatgatcctcttgtgatgaagcaaaagaggaagagtatactccttttccgcttgtacaaatattttttttgataataaaatttggcacttcagagcttatcgtatcttctcccggagttcctcaagacttatacttcagcccgtttaggaatgcataaaagcaaataggattcgttacaactgctgcaggactctttaggactgcatcaaggtaagcctcgctgcacctaaacgcaaaatgtggttgtaacctttttaatttttttcttgaacttgttgagtcgtaataaatcgtttctgggaagtggaaggtaataatgtaatggaatcggcgttactcgcatgtgcagatatcagcgacaaaaagtgttgtagggacgtttcgataccaaaatttcctaaatacagcgcaggaacatcactacgctaaacaaatcgtagcgcatacatctgatcgaaaaaagacagttcccaaaacaatgacatatgaagagaccagcatcaaaattttcatcattaacagcatggctaaaagttattgtttaatatacccatacctgattgacgaaccaagaaatgccttatcactatttatttttggcactcttcacctacctggccacgtccaatgttgtttcaggaagtacacaagcatgcctgccagtgggcccgaggaaaaatgggatgaatgtcaacttttataaatactcattactggattcaacaacgtattcctacccgcaatatatgacttctggatatgcctcgaattggaattaggttccgttggcggacagacggatttctcaattgactacgatctttcttgtgttatctcttcaggaacttttaaatgtgctcaatcagatgcttatggaaactggggatgcagaggtcatagtgaatgttcaaaatagccaagaaagacctattggagtactgatttacttggtttcttactatcccaaaaaacgctactctagaaatgacaggttactttttaccaccacaaacaagttcttacacgttcaggtttgctaaggtcgatgactctgcaattctatcagtcggtggtaacgttgcgttcgaatgttgtgcacaagaacaacctccaattacatcgacggattttacaatcaatggtattaagccatggcaaggaagtttgcctgataacatcggagggactgtctacatgtatgcaggctactattatccgctgaaggttgtttactccaatgccgtttcctggggcacgcttccaattagcgtggaattgcctgatggtactactgttagtgatgactttgaagggtacgtttactcttttgacgatgatttaagtcagtcaaattgtactatccctgatccttcaaaacatactactagcatcgtcacaactactaccgaactgtggactggtacttttacttctacatctactgaaatgaccaccgtcaccggtactaatggtcaaccaactgacgaaaccgttattgttgccaaagctccaaccactgccacctcatccagtttgtcatcatcttcttcagaacaaatcaccagctctatcacgtcttagcatccaattattactccattctatcgcagcaatggaacttctgtagtttcttcctcagtcatgtcttcctcggtcatttcttcttctgcaacgacctccacttctatattctctgaatcatctaaatcatccgtcattcaaaccagtagttccacctctggttcttctgagagcgaaacaatcttagtgattgctggcatgtcattagcgacaagacgcttattaccgtagtagccccccaaggcaaacatctctttatcagtaatatccaaagctgttcaacttctcgaattggcccaggaaaagagcattggggcggcaactaactctggcatacttacagtttctgctcttgacagcgctaaaaaagggcttgttttgtaatgcccggttcgcaattctacaagtaccacgcactagctgctaaaagtgtctaaccttgcgaacaaatctggactttcttatgagaatcccatcgtcaagaaacaaaattatacagacaggcgtaaatgtagctcgtaagcgcctgatcaagtaagccaaatgcgctaacttgaggaaatatagccatctaaatctctgcaacatgccaattcgcacgtgacttgaaactatggaaagtgtctagaagattaccaagaaccacgttatttgagagaggatggcaaggtgacgacaatcacaccaagaccacattttgggtgcgcctggaagcaagacctgagaaactgggccaaaatattcaaaccaagcataagatagttggaggtaggaatacactatctaatctgtgctgatgaaatgctggcgaaaacgggcgatgtagtggtacagaaggtgccggttatccgtttgtccgtttttcttcattttttttttgtttttcccttttgtcttttgcaccgcttatatatgggtatgaaacaagttcaagaatttataatggaacccaaaggttcagtctttgtagttcgagcgacattgcgcgtttccttagaaaacgctggaaagatattctttaacgagacggagtaattctcgtcaggaataggatgttgattgatttttgctgtagttatatagcagggacccacggaagagagcgagcgccttctttcacagggacttttgtcagccacgtctccggggaaaacaattgccgtccgcgtcgcagtgagattacgcagccgtgcgcttcagggacagaaaagaagcatttcgcggctacggagaaaccgtgcactaactctctcgagggtagccgcaaagatttcttgtctcttccattaggacatagctatctttttcttttctgtttttggcgtatgatctgttctgagccaaagttatagatcattgcttgaataagcacctcacagagtagggattgtatagaaagtagctgagcgtctgcccacgtaacaaacaatcttgccccttccccgctcttgttttcgcgtgcctcttctacaataatctggccaggctgaatcgcgttctgctgctgctgctgctattgttattgttgttgttgttgttttggccaattgcttatgtgttggtctgcaaattagcacctcgttccctgttggcaaacgcgcgcgtacaagccttacagggcttgagaatgttcttcgtagaaatgcatgcacaaaaattctgatctagcacaccatcggtctctgtagcttcgggctctatagctatgggttaggagtccgtgagtagtaacaagaagaagtatataaaaagcaggtaaatcgtacttcaatatgcttcattgtcactggatcgtcatattcactcttgttctcataatagcagtccaagttttcatctttgcaagctttactatttctttctttttattggtaaactctcgcccattacaaaaaaaaaagagatgttcaatcgttttaacaaattccaagctgctgtcgctttggccctactctctcgcggcgctctcggtgactcttacaccaatagcacctcctccgcagacttgagttctatcacttccgtctcgtcagctagtgcaagtgccaccgcttccgactcactttcttccagtgacggtaccgtttatttgccatccacaacaattagcggtgatctcacagttactggtaaagtaattgcaaccgaggccgtggaagtcgctgccggtggtaagttgactttacttgacggtgaaaaatacgtcttctcatctgatctaaaagttcacggtgatttggttgtcgaaaagtctgaagcaagctacgaaggtaccgcgttcgacgtttctggtgagacttttgaagtttccggtaacttcagtgctgaagaaactggcgctgtctccgcatctatctattcattcacacctagctcgttcaagagcagcggtgacatttctttgagtttgtcaaaggccaagaagggtgaagtcaccttttctccatactctaacgctggtaccttttctttgtcaaatgctattctcaacggtggttctgtttccggtttgtaacgtagagacgacgatgaaggctctgtaaataacggtgaaatcaacctagacaatggaagtacctatgttatcgttgaaccagtttctggaaacggtacaatcaacatcgtctctggtaacctatacttgcactaccctgacacctttactggccaaactgttgtattcaagggtgaaggtgttcttgccgttgacccaaccgaaaccaacgccactcctattcctgttgttggctacaccggtaagaaccaaattgccattaccgccgacatcactgctctttcttacgacggtactactggtgtcttaactgcaacccaaggtaacagacaattctcttttgaaattggtactggattctctagttctggcttcagtgtctccgaaggaatcttcgcaggcgcctactcatattacctaaactatgacggtgtcatcgctacaagcgccgcatccacatccgcatccactacctctggtgttgtctctactgccactggttcagtcactttatcctctaacgcttctaccaccgtctcttctacgatctcttctagcgccccagactcaataattccttcatctagcgcctctatctctggtgtctcaaactccactacagcatctggttcaatcgcttctactgcttccaccgcttccactacttctactgcatccgctgcatccgccaccagcttcacctcaggttccgcttctgtctacactactacattaacttacttgaatgccacaagtacagtcgtggtttcctgttcagaaacaaccgacgctagcggtaacatttacaccattaccacaactgtcccatgctcatctaccactgccaccatcacatcttgtgacgaaaacggatgccatgttccagcaccaactgctaccgacgcaactgcaaccgtttcctccaagtcatacaccactgttactgttactcactgtgacaacaatggctgtaacaccaagactgtcacttctgaatgttctaaagaaactgcagcaaccaccatttctccaaaatcatacactactgttaccgttactcactgtgacgacaacggctgtaacaccaagactgtcacttccgaggcttccaaacaaacatcattggccactagcacagtcaccaagtctgctgctccaacttctcatactgctgcttccagcaccttcactggtattgtcgttcaatccgaaggtatggctgctggtttgagaaccaatgctttaagtactttggcaggtattttcatccttgcttttttttaaaatgagtgcgtaaccgtactttcctaaaaataactaagtagaaagtattttaatatataaacgtcagtgtaaacattcaagtgattttaactttacgcggttgaagaatgctgtgttcgaactataaagcgtcagaaaagatggtttagcgaaggcaccattatgaagatagacacattcttcttttttttttttttttttttttttttttttttttttcatttacttttatttcgcgcggtcggtaaatttttcgtgggtttctttgaatctattagccgacataagaataatgcataaataatatttttaatgtcttcctatgcccaaaagaagaagtcttgaagttgccgcacatggaaatcacatgaccatggcttggcccttcgttttaaatgcaacatgcaatatggaatgtgtcatgaatactatcagcaggaacagaaagcgtcgttttgtttctgcaaatgctgtagttttgggccgaaaatagatgtagtagaatatatagtgaaacgtgatgtacaaaagaaaaaggtagtttaaaaaaaattagataacttggatttttaccctgaatattgcatgtgattcgtaaagaactgagttacctcaaacggacctcccttttcatttcgtattccgcgaatcatgaagtcatgcaattacctctgaagagctgactgtcccaaaagaagctatcgaatctgtccttgatttatttaagccttgcgtttcgagaaagtgaaaaccaattgaatacaaaataaaaaaaaagaagaaagaaatagcaggtctaagatatataagaaagttaatatcatttttgaacattttattttagacgccttcagccgcgcgacgcccggagtaatcatatgcccatgactttaccaaaaggcaacagggaggaacatgcattaatgtgaagcatcactgctgcaattctcggtgttgctaataattcatggatcgagaaagagacataacatttaggccaattttttgaataaatatgaactcagctaagactcgacaatacaattttcttatactaaacgtagatttataaaataaacacaactgtaagggcaatgcaaccgtagatgcatatatcatttatagaaattatatccaacagaaagctcagacttatatccggtttaagagagaaattcttgctcatattaccccaagaccaggtggcgtgttgaagtttataacatataagaactactacctcatgaattctagtggatgaaagaagcagcacgaacaccatttctacagacaacgacacatggaaaggttcaccattcccaaagaaaacaacgatggccacaagggtgtggtcctccattctcctactgttggaaggagatattatccgaccgactgttttgtgatatggcaaactatttttttaaatgagcaaaattacttcttttggctggaaatgtcattagaaagtgcccaagtgacatttagctaaactcgggtattgtctacaagaccggtgctgtgaccgtttccaatacggaaagaaacggtactgggagcaggagttgcttttacagatatgaacaatgccaatagagccgcacatgtaattactggttcacactcgtggggcccacacgattcctgtgcaaagtttgacaagaggatggagtttcacgtaaatgctgccaaaggtgatgcggttttgtttttgggcagcctctaccatgttgcaagtgcgaaccatactgtggccacatagattacaaaaaaagtccaggatatcttgcaaacctagcttgttttgtaaacgacattgaaaaaagcgtattaaggtgaaacaatcaagattatctatgccgatgaaaaatgaaaggtatgatttctgccacaaatatatagtagttattttatacatcaagatgagaaaataaagggattttttcgttcttttatcattttctctttctcacttccgactacttcttatatctactttcatcgtttcattcatcgtgggtgtctaataaagttttaatgacagagataaccttgataagctttttcttatacgctgtgtcacgtatttattaaattaccacgttttcgcataacattctgtagttcatgtgtactaaaaaaaaaaaaaaaaaagaaataggaaggaaagagtaaaaagttaatagaaaacagaacacatccctaaacgaagccgcacaatcttggcgttcacacgtgggtttaaaaaggcaaattacacagaatttcagaccctgtttaccggagagattccatattccgcacgtcacattgccaaattggtcatctcaccagatatgttatacccgttttggaatgagcataaacagcgtcgaattgccaagtaaaacgtatataagctcttacatttcgatagattcaagctcagtttcgccttggttgtaaagtaggaagaagaagaagaagaagaggaacaacaacagcaaagagagcaagaacatcatcagaaataccaatgttgaagtcagccgtttattcaattttagccgcttctttggttaatgcaggtaccatacccctcggaaagttatctgacattgacaaaatcggaactcaaacggaaattttcccatttttgggtggttctgggccatactactctttccctggtgattatggtatttctcgtgatttgccggaaagttgtgaaatgaagcaagtgcaaatggttggtagacacggtgaaagataccccactgtcagcaaagccaaaagtatcatgacaacatggtacaaattgagtaactataccggtcaattcagcggagcattgtctttcttgaacgatgactacgaatttttcattcgtgacaccaaaaacctagaaatggaaaccacacttgccaattcggtcaatgttttgaacccatataccggtgagatgaatgctaagagacacgctcgtgatttcttggcgcaatatggctacatggtcgaaaaccaaaccagttttgccgtttttacgtctaactcgaacagatgtcatgatactgcccagtatttcattgacggtttgggtgataaattcaacatatccttgcaaaccatcagtgaagccgagtctgctggtgccaatactctgagtgcccaccattcgtgtcctgcttgggacgatgatgtcaacgatgacattttgaaaaaatatgataccaaatatttgagtggtattgccaagagattaaacaaggaaaacaagggtttgaatctgacttcaagtgatgcaaacactttttttgcatggtgtgcatatgaaataaacgctagaggttacagtgacatctgtaacatcttcaccaaagatgaattggtccgtttctcctacggccaagacttggaaacttattatcaaacgggaccaggctatgacgtcgtcagatccgtcggtgccaacttgttcaacgcttcagtgaaactactaaaggaaagtgaggtccaggaccaaaaggtttggttgagtttcacccacgataccgatattctgaactatttgaccactatcggcataatcgatgacaaaaataacttgaccgccgaacatgttccattcatggaaaacactttccacagatcctggtacgttccacaaggtgctcgtgtttacactgaaaagttccagtgttccaatgacacctatgttagatacgtcatcaacgatgctgtcgttccaattgaaacctgttctactggtccagggttctcctgtgaaataaatgacttctacgactatgctgaaaagagagtagccggtactgacttcctaaaggtctgtaacgtcagcagcgtcagtaactctactgaattgacctttttctgggactggaataccaagcactacaacgacactttattaaaacagtaaatagataatatgattatgtaattttagaaactaattatgaataccgatttatttttttttttttttttcacttttgctggcaagaaatacgaaattgcaatgacgatcacagtccaaagaggtaagcacaaaggcgcagtatgtgattactctatcattctttagcaaaaccaggataggagtatatgtataagaaatatgcaacgccatcatttaatgcaatagacacgacatgccctttacatgaggtggtacaatgttttaatattgtgtcagggcaagtacatgataatatcgtttaaagatgatgctagagtaaaagtatgaagtgaaagaaaagggcaattgattgactaagcggatgttgtaggatgatatagtggctcatgatctgtaaatgatcggttgaccgcagtattatataataacatccgtataagtacatatactaccatgtctgttctctacattgctttttattcaagattattggttttcctaaccgccgcgccgcgcaggtaccccgcgcatctcttcttctcgaagaaagcggaaaaaacaaaaaaaaaagtataaatagtggagtcttttcccatttaacatttagaaaaaaattcgaatggaaatttcttgccgaacatttaaccggagacccttggcggctttttctcagtttcgtgggctagtacattttacctagtatgctgggaactttttttccgtattctattctattccttgccttacttttcttatcattttttatataaccaatttcaaaaatactttttaactgtcatagacgcattttgtttattacaaattaaaagaatcaaatataatatgtgcaattaataactccacaagtagcgaaagcaatggccgccattagagactacaagaccgcactagatcttaccaagagcctaccaagaccggatggtttgtcagtgcaggaactgatggactccaagatcagaggtgggttggcttataacgattttttaatcttaccaggtttagtcgattttgcgtcctctgaagttagcctacagaccaagctaaccaggaatattactttaaacattccattagtatcctctccaatggacactgtgacggaatctgaaatggccacttttatggctctgttggatggtatcggtttcattcaccataactgtactccagaggaccaagctgacatggtcagaagagtcaagaactatgaaaatgggtttattaacaaccctatagtgatttctccaactacgaccgttggtgaagctaagagcatgaaggaaaagtatggatttgcaggcttccctgtcacggcagatggaaagagaaatgcaaagttggtgggtgccatcacctctcgtgatatacaattcgttgaggacaactctttactcgttcaggatgtcatgaccaaaaaccctgttaccggcgcacaaggtatcacattatcagaaggtaacgaaattctaaagaaaatcaaaaagggtaggctactggttgttgatgaaaagggtaacttagtttctatgctttcccgaactgatttaatgaaaaatcagaagtacccattagcgtccaaatctgccaacaccaagcaactgttatggggtgcttctattgggactatggacgctgataaagaaagactaagattattggtaaaagctggcttggatgtcgtcatattggattcctctcaaggtaactctattttccaattgaacatgatcaaatggattaaagaaactttcccagatttggaaatcattgctggtaacgttgtcaccaaggaacaagctgccaatttgattgctgccggtgcggacggtttgagaattggtatgggaactggctctatttgtattacccaaaaagttatggcttgtggtaggccacaaggtacagccgtctacaacgtgtgtgaatttgctaaccaattcggtgttccatgtatggctgatggtggtgttcaaaaacattggtcatattattaccaaagctttggctcttggttcttctactgttatgatgggtggtatgttggccggtactaccgaatcaccaggtgaatatctctatcaagatggtaaaagattgaaggcgtatcgtggtatgggctccattgacgccatgcaaaagactggtaccaaaggtaatgcatctacctcccgttacttttccgaatcagacagtgttttggtcgcacaaggtgtctctggcgctgtcgttgacaaaggatccattaagaaatttattccgtacttgtacaatggattacaacattcttgtcaagacatcggctgtaggtcgttaactttactaaaggaaaatgtccaaagcggtaaagttagatttgaattcagaaccgcttctgctcaactagaaggtggtgttaataacttacattcctacgaaaaacgtttacataactgaatgttaaatgggatcattaatacaatagtactgtacgtatggcacctgtacatactgcgttataaatgtactaatggaatgatatattaatatatagtgtgtttataccttattattgatgattagtatatatttttatatttaggtgattttagtggagattatttggtggtaattacactagtatacataaaatgggtagtggatatttgtatagaaagggcattacgcatggagttaagagtatttacatgataattgggttccgtgattcattatagataataaaacgtggataatattgggtgttataggtaaatgggacagggtatagaccgctgaggcaagtgccgtgtatggtgatgtggtatggtatcgagtaccgatggagtgagagatggccttggtgtagagtattatggcgggtaagttagatgatgtattgtttacgttatatttgtttaaattggatttgtttacattagatttgtttacatttcaatatatcaatggagggtatgtagcattatggtaagtagcacgtggtagatggggattgtaggtggatggtaggatgagtggtagtgagagttggataagatatattgggcaggggatagatggttgttggggtgtggtgatggatagtgagtggatagtgagtggatggatggtggagtgggggaatgagacagggcatggggtggtgaggtaagtgccgtggattgtgatgatggagagggagggtagttgacatggagttagaattgggtcagtgttagtgttagtgttagtattagggtgtggtgtgtgggtgtggtgtgggtgtgggtgtgggtgtgggtgtgggtgtgggtgtggtgtggtgtgtgggtgtggtgtgggtgtggtgtgtgtggg

SEQ ID NO: 12205 - DNA, 813137 bp, Saccharomyces cerevisiae
aaatagccctcatgtacgtctcctccaagccctgttgtctcttacccggatgttcaaccaaaagctacttactacctttattttatgtttactttttataggttgtctttttatcccacttcttcgcacttgtctctcgctactgccgtgcaacaaacactaaatcaaaacaatgaaatactactacatcaaaacgcattttccctagaaaaaaaattttcttacaatatactatactacacaatacataatcactgactttcgtaacaacaatttccttcactctccaacttctctgctcgaatctctacatagtaatattatatcaaatctaccgtctggaacatcatcgctatccagctctttgtgaaccgctaccatcagcatgtacagtggtaccctcgtgttatctgcagcgagaacttcaacgtttgccaaatcaagccaatgtggtaacaaccacatctccgaaatctgctccaaaagatattccagtttctgccgaaatgttttattgtagaacagccctatcagcatcgacaggaatgccgtccaatgcggcactttagatggggtaactcccagcgcaagctgatctcgcaagtgcattcctagacttaattcatatctgctcctcaactgtcgatgatgcctgctaaactgcagcttgacgtactgcggaccctgcagtccagcgctcgtcatggaacgcaaacgctgaaaaactccaactttctcgagcgcttccacaaagaccgtatcgtcttttgcctcccattcttcccggcactttttttcgtcccagttcaaaaagtactgcagcacctctgtcttcgattcacgcaagttgctccatactttataatacaactctttgatctgccttccagacatgcggaaaacttggctcccttgcttgcctcttgtcgaatccaatacactaattgtttctcttcttctagtaatggccaggtaccaagcataatttctctgtatctgagagtagatctctctcctttttacgctaaaatatttcaaatatcctacagggtccccatgatatggctcgatgtcttccaagtattctttgtattcctcatcatttcgcagcattctctccacagctagtgcttcccaagctatcctccgatacgatactttctggccagcccaacagacacagagcccgaacatcttttgacagcccttgcataatccgtattgtgtgaatactccctctgggcagaagtatatgtcaataccatagaggaaaagatgtttaatttcgtcagaccgaaatccaagaaactgtaagacattcatattctcggaagtattgggaaattgtgctttcagtttctttctctctaggaaaaccatttgactccctttccgcttatacgactctttgttaatgtcggtgactggatggaatctattatcctcagcattgccatctttattggcgtcctccttggcactagcgttggtactttcagtggtagtggcattagtgctggagttggtgctagcagtggtagtggcattagtgctggagttggtgctagcagtggtagtagcactagtgttggagtcggtactttcggtggtagtagcactagtgttggagttggtactttcagtggtagtcgcactagtcctgacgttgatgctagcagtggtagtagcattagtgttggagtcggtactttcggtggtagtagcactagtgttggagttggtactttcagtggtagtagcattagtgctagagttgatactttcagtggtagtagcactagtcctgacgttgatgctggcagtggtagtagcactagtcctgacgttggtgctggcagtggtagtagcactagtcctgacgttggtgctggcagtggtagtagcattagtgctggagttggtagtcgcattggtagtagcactagtcctgacgttggtgctggcagtggtagtagcattagtgctggagttggtagtcgcattggtactggcattagtgttggagttggtactttcagtggtagtcgcactagtcctgacgttgatgctggcagtggtagtagcattagtgctggagttggtactttcagtggtagtcgcactagtcctgacgttgatgctggcagtggtagtagcattagtgctggagttggtactttcagtggtagtcgcactagtcctgacgttgatgctggcagtggtagtagcattagtgctggagttggtactttcagtggtagtagcattagtgttggagttggtactttcagtggtagtcgcactagtcctgacgttgatgctggcagtggtagtcgcactagtcctgacgttgatgctggcagtggtagtagcattagtgctggagttggtagtcgcattggtactggcattagcactaccatgaatgcacgtgtcgctgtcctcatcactgctgcaatactttctgcacctgtcactgctattgctctcctggaagctagacggtaacgcaacgatcgacatggaagctgtcgcctgattttcagccaatctgtccattctttctatcagttccactgtgtcagcagacaggtctgtcctggagccacagcatccaacatgctggccctttttttcctttctttgattcaagtccatagaactcgcgtacctgttcggttatacagccttccttaatcggtggtaattcacccttacgattccttgccgcccaactgttttttctagataatagataacagaggcccccatctcttagtctccctacgccttgaatgagctcaataatattaagtctattatcaagcatgatcaccatcatcaattgcttaatgtcaattccttcagtcactaatttcgttccgatgagaacttgcatgctaccgtcagtgacaaactcctttgtgcgagacaccttttctgcagcacccaagcttcccgtgtatccataccaccctaaaatactttctccaagagcaggccaattcttccacttcgttggttgtgcttgcaactacaatggccttcgactctggttcaatttcaaagagggctaaaagaagcttcagtgcttcttcgggctgtgattccactttcttccaaattttatgaacatgccctaaaggcacctcggatttctccttgattagattaaacatccgtgttggatagctggatagacctctgctgagatcttccgaccgtttgagctcgttgatgtccatcgacttcttggccagtcccgtaagcccaatacgctgcaacgcagcatcagcaacagcctcaggggctgtgccgctcaaaaagattgctttctcaaaagcgtcaaaatcaaggttagttatgcccccaaattgcgactgccggtagacctccgtttcaaagttgtgaaactcatctacaatgaggtaacccaattttacgttgttggtcctaaaggtgcactcaacaatattctcccacgcagctatcctgtctgtgaaattagtgctagcaagatcatcgtagatccccacgtataaatcagtaacgccatcgcaaccttcttcaataaagtttcttacaggggccacattcaagcaaccgcgtcggcccaacctgatcatgcaattagcaagcaacactgtgtacggtacaaacagaaacgacacatatttcacgtcgcccttagatgccagtgctatcaaggggagatgaaataactccgtcttaccatagcccggtggggcctgtactgccacagagggtgtgtctgccatgtatatttcatgacataagcgcaactgatgcaagtccctgaattcaaaggagctgccaaagagtttccggcctgcgacgaggatatcgtttgtactcttgggctctcggggcctttttcgcgttactcttgaaattttttgatcatgatctgaactcgccgcctcacctgccactacgtcttccgcattccgagtactagagaatgaacaatggtagtcgctttcaaggcctaaccattgaatccagcgctcggaagtgagtccgtcaagcgtctttagtcgaggctccgatgaaccgttcttgttgtatcgtcgacgtatacgttgcgctgtagctctggataacggtaagcgtatcaccgtaagctcgtcaattatttttgagagccgcggtcattttgttagtatctcttctcaacttgggcagcacacatgcaaaacatcacccaatcggtcctttttgttcatcatatcgttacatatctgtgaaaagtactttatctcagtgggtttacgtgggcatagatcacgcttcagccgctctgtgtcgactttcttttcgccaggtaaacttgcttggtatgcagaaaaaatcgatagctcatctacgtgtagtaacaagaacatgtagggtgccaaattgtatccatatttccttatggtgcttttctgaagactccttacaataggtgtgccagaaacaaagtcagtgaaagtacgcatcgtagagctgtcgttcggcctggcactcgctatttcgtaacaacgttccaggacacggaaactcaactcattatagtatcctctgttgaggtaaaaaagagaaagggtatcgtaatcctttctattgaatttcaaagtatgcacttgaaacaacgtgtagaccatcaagttgattttcttgggaataagatactttgaagggattggtccgccctggaaatctggttcgtcttcaacaaacgtcaggaacttttgtacatttttcccgaccatgacggaaacgacaattttttcaaaagaccttttcctatccattgcaccagttctgaattttaccactttgattagaccagacttttcgtcttcgtagaatgaccgcacttccgtggggatcgattcaaataaagttattgagggacaatgtaccaagtcgtttttgttatttagagccgactcaaactcgtcaaagtttgctttttcaaacttacgcctatcggaaactttcattttatttttgtaagtttcgaaattaacaatagtatgttgattgctatgctttttgacaagaaatccatcaatataaacaaaagattgtccagtttccgtcttatcatcatctaagaatgtaataattaagctactctattgagaagaagcagaatctgcgctatgcaggtgcaaatctccagcagcagcaaagaaaattcagttaataagaaatctcactaagataagcgactgtctgtccccttcaagcacaacatagaaaacagaaggatgtctcattcatcgcttgatttccggcctgcaaaaataaagtagtcggtacgtactttcgttttcaatttccatggtgcacagtatcttaactatctgcttagtcgaggagaaccaggattctgttcgttgctcagccgcttcgtggatattctcttggatactttaaacatggacctacgttccgctctcgaaaagaccaatataataaaaagttataaattacatttccttattaggtatacgacctcgcgcttcgaagtagaggagccctttttggcgtacctacatatggcgcgtcagacagacaaacttcccccaaaaatgtattaccccgccgaataagaaaacagacccattcacccacgacgtatcaagttacttccttggtgcaatgtcccactataaaaaaattccttgacgctagatcgttggactaaaatctgcgtcacaatcgcctaaacaggaaatattgcctattttcgtacaaggttacttcctagatgctatatgtccctacggccttgtctaacaccatccagcatgcaatacagtgacatatatatataccctaacactaccctaaccctaccctatttcaacccttccaacctgtctctcaacttaccctcacattaccctacctctccacttgttaccctgtcccattcaaccataccactcccaaccaccatccatccctctacttactaccaccaatcaaccgtccaccataaccgttaccctccaattagccatattcaacttcactaccacttaccctgccattactctaccatccaccatctgctactcaccatactgttgttctaccctccatattgaaacgttaacaaatgatcgtaaataatacacatatacttaccctaccactttataccaccacacatcacatgccatactcaccttcacttgtatactgatatgccatacgcacacggatgctacagtatataccactctcaaacttaccctactctcacattctactccactccatgacccatctctcactaaatcagtactaaatgcacccacatcattatgcacggcacttgcctcagcggtctataccctgagccatttacccataactcccacgattatccacattttaatatctatatctcattcggcgggcccaaatattgtataactgctcttaatacatacgttataccacttttgcaccatatactaaccactcaaattatatacacttatgccaatataaccaaaaaattaccactaaaatcacctaaacataaaaattatttatctttcaactttacgaaataaacacactcaattgcgtatctataccaccatgacgtcattaacgtaaaagttccttaatattaccatttgcttgaacggataccatttcagaatatttctaactttcacagaccatacattagaataatatgccacctcactgtcgtaacactctatattcaccgagaaacaatacggtagtggctcaaactcatgccggtgctatgatacaattgtatcctatttccattctcatatgctatccgcaatatcctaaaagcataactgatgcatctttaatcttgtatgtgacactactcatacgaagagactatatctaaagaagacgatacagtgatatgtacgttgtttttgtagaattataatgaaacgtcaaataaccctactatattataacttatcagcgccgtatactaaaacggacgttacgatattgtctcacttcatcttaccaccctctatcttattgttgataaaacactaacccctcagctttatttctagttacagttacaacaaactatcccaaaccataaatcttaatattttaggtgtcaaaaaatgaggatctccaaatgagagtttggtaccatgacttgtaactccactaccctgatctgcaatcttgttcttagaagtgacgcatactctatatggcccgacgcgacgcgccaaaaaatgaaaaaagaagcagcgactcatttttatggaaggacaaagtgctgcgaagtcatacgcttccaatttcattattgtttattggacatactctgttagctttattaccgtccacgctttttctacaatagtgtaaaagtttctttcttatgttcatcgtattcataaaatgcttcacgaacaccgtcattgatcaaataggtttataatattaatatacatttatataatcggcggtatttatatcatcaaaaaaagtagttttttattttattttttcattacttttcactgtctatggattttcattcgtaaaggcatcactccctagtttgcgatagtgtagataccgtccttggatagagcactggagatggctggctttaatctgctggagtaccatggaacaccggtgatcattctggtcacttggtctggggcaataccagtcaacatggtggtgaagtcaccgtagttgaaaacggcttcagcaacttcgactgggtaggtttcagttgggtgggcggcttggaacatgtagtattgggccaagtgagctctgatatcagagacgtagacacccaattccaccaagttgactctttcgtcagattgagctagagtggtggttgcagaaagcagtagcagcgatggcagcgacaccagcagcgattgaagttaatttgaccattgtatttgttttgtttgttagtgctgatgtaatcttaacaagaaatagtgaaatgaaagcgcatacctcaaaggcatatagttgaagcagctctatttatacccgttcctccatctgtcatcactacttaaacgattcgttaacagacgctcatttagcacctcacatattctccatatctcatctttcacacaatctcattatctctatggagatgctcttgtttctgaacgaatcatacatctttcataggtttcgtatgtggagtattgttttatggcactcatgtgtattcgtatgcgcagaatgtgggaatgcctattataggggtgccggggggtgccttgaaaaacccttttgcgcgcctgttaagtttccgttttcagtcaaaaagaatatccgaattttagatttggaccctcgttcagaagcttactgtctaagccatcatttggtgtgtcctaaacggtttccatgcaaagcaacatctttgttactcattcctgaaggttgaataaaaaatagcaaccatgtgcagggagtcgtatattgttagattctagagacttgtacgcatcatcaaagctgtaaatagaataaacatacgcaaggcgtcaaaagtgcatagttaagaaaattcctgacatgtgaaaatatgtgtttatgaaatgtgtcaaggcccgtctatagcgtagttaacccctctgcaggagtaagtgactttttttacgctcaaaaggcaacgagggcacatacttaaaagtcattttcaaacacatctgcagtttgcaacgacagataacaatattatgataggatggtatgatgttattagctgccacatattttttaacatagcattagtcacgtctcttcaattgttgggatgaaactctaaaatatcattcctttagtagtattccagttaccagtatattatcacatgccgaaaaagaagatgacataaagatcgacaaacagtcttcaaatataatggaagctggaatgcaaggattgataatgtaacaggatactgaatgacaaagtataaatgaaaaaaaaaaaaaaaaaaaagtagtaatactattatgtggaaataccgattccattttgaggattccaattgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaacgatgataataatatttatagaattgtgtagaattgcagattcccttttatggattcctaaatcctggaggagaacttctagtatatctacatacctaatattatagccttaatcacaatggaatcccaacaattacatcaaaatccacattctctacaccaataccatcgacgagagcttctagtaaattgtatacataacagtataacccttaccaacaatggaatctcaaagattattaaattattcacagactctgaggattcgggtaaaatagggtatttaactggttaccggaaaggtttagaaaattcgtggagggttggccgagtggtctaaggcggcagacttaagatctgttggacggttgtccgcgcgagttcgaacctcgcatccttcagtattttttttgatgatttaacgtactattaactagaataatagggaaatgcaattgcagtttgagaagaagaattattaataagccaaaaagcggctcactaagtaagtttttcttcatggcgtcctttgcatccagcaataatggttttagcaaaaaaatctctttcactacacaagttggagcatattttttaacaaatacagataaacgaaaggcgataataagtatacttcctatgtacaagaatctttaagtgatataatctttcagcggactagaagaatagggcgttcaactgttgtccttgcagaattgcgtaaactccttcaagtagtcattattttgctcgcagttttgccttaaaatgccctctgttgtagaagttaaaatttgttctatttttctattatttgccacccactctgtcaccttcgtccaatccttatattgagcttcctgtttctccgctctttctcttgcagcgtaaggatcaattcttgcgtctataagtggttccgcagtagtctttttattattaccgcactgctgatcggtctcgttcttcatctctgctgcctctttttcgcaaaatgaaattatattattccgtatttgccagttcggatatagttcttgcttcaaaaattccttacacttattttttccattaatagagcctttcctatagttgtttaatttttgtcttattatatcatcacttccatgccttagaaacctcaaaaatgaatctatcaagcttggatcaacacatctttctcgcgtaactgtgattgtagtaagtgacggttcatcattcggaaaagtaagatttgtttcaagtaagctttggggtgccgtaaacgtacgcctattatcaaccataccgtctttttgtctacgtgtataaatgagaagttttttttctaactatatccaagtttttcaaactacccaaaggatatttaacttggcggacaaaattaccgtcacgttcaaaagtgaatatataggcgattctgggtaacaagcaaaagtaaactacaatatggaatagtgtaaaacttcacttatcaacaacaaaatcgcttcaagcctcctatcttagagtctagagcctgataaaattcttatgcgagcaagggcaacctgatcgaattttataaaaactatttatggactaaaaacctacagcgctcttcatcatatcccttcccgtttcttccattgcgtcattcatggtttgtcccattgtggttgcatagtcattaatagtggtttctaccgtgtctaaacgagtttcaattgccctagaaacacttttaaggacaccatatccattacttcttccagagcttcttacaggtctggcatacctgtgatctttcgtaccgggaggtaactttctggctgcattactactactggaagatatgcatcctcgagcaattgcgctttcctcatacttcgattcgggcctttctataccgcccagtagctcatcaagttgatatggtgtgcaataaatagttcctctagcccattgtaaggaattcacttgaggcctataaccaatctttaaatcaggattgtacaaggtatcaataggagtatgttgtgatatgtcagcagtatgattcgaaccggtggcactttcattaagtactgaaatcaaagaagcttggaatttccctgtgcgaatgacaatgtcaacattttctaatatagatgaattttcaacgtattgagcgcttagagggaccgggcagcgtagatttttgacttccttaagctcaggtactgtcaaaactttaatatctccattaattagcaaaacgatcataatagttgaaagctttctttctcctttaccgtcaataatgggaataaatgataatccactagtggcaattggatacttgaaaagcgcatgagtgtccttagatttacctggtgatactaaacgaatgtcatttgcgccactgatagtaacaaatccaggtattgcgatacccttgcttaaaccctgcatctttgatatagtagcagaacaactgtagccagtatctttggcaaaagaatttattcctagaatttttccttgattgttggtctttgttgcatcagtgaatttaacctcaaatcttccattagttgcaggcagtattttgaaagtcatcaattccccgatatccgttccacatagcatcaaaatactagagaacccatcatctccatattccatgacgcaaaagtgaacggttgaaacgtaagagctaccagctttagaaatgaccctaatattttcattgaagattatagccgggcctcttctgtccaatattattaaggttccttcaatgaaaccaacggcaacgaacccgatattactattcatgattgcggacaccgcaccttttttagcatgtattaccgtacttggtataaagccttgtttaacgttcgtaggccctctatccgaaacatcaactaaaatagtttttgaatcatccaatgaaaatctgctaaacttcaattgcagtgcatcgcttttgggaagttgtccgtaaaacttgtttgtttcgaatttgaaaagaataacatccccaacctcagatgataccgccaattccaatgtttccgatgcaaaggagatattttttatggccaggttagtagctctgttaagtactttagcagtattcacttcaaatacagcgttgtcagttacttcactgtgtgaagcatcccatattctgactgaaccattactatgcccagttagtaaagcagatctggtctcatgccttctaatatttctggtggcaggaataccaccttttaaaaacgattcactttgagcgattgtcatcatccccagccaaagatttttttgaactgattgcgctatacaagtagtaaccgttggtcgaacccatgctaagctccgagggaaaatggaggccttggaactaaaagagcctgctgggtatatcaatgtttcaagttcgccatcttctaaaagtaataaaatgaggtttgtgtcatggcatccaccaaaatatggagaagccttcggcaagggtagaaaatttattagtggagctttgccaatcaacgaaaatagtttttgttgaaccggtttagcatagtacttgctcattgcgtcaaatgatgtcacagaatacattggtgtgccgcctaagtcaatcatggttatttcctgaggtaaacagggattttctgtagcttttgttgcaatcaacaacgatgtatactcaggattacgctggcaaagccagcttactttaaagatagcgggtgtttctgtaaaggaacagtctttcaaggcaggatttggaaaattcacatgtgtttcaaatatacttctagcgtgaatcagtttaccgctattgacatcccaaaataccaaggcattatcttcatggacagttaatatatgtaaggaatttgggtgataaagtgactgaatgacctttggagtgcgtttcttttctatgtttgtggatagatcaccgcccggagcatacggttctaattggtaaaaaaaatgttgcttgactttgtagtcaatgaaagaatatatgactgtaatatgctcatatgatataagtatcgttcctatgtctctaggattccattggatagaaataaccggtgatagcctctcttttggcaaaaacacacttttctggaagttttcaattttcaatttggacatttgatttctatccacatcatagatcaatatggatccactctcgaggccaatcagcatccaatccaagggcggatcagtctcaaaacaagtgatgctgtttggacagaaaacagtagttagaatctgtttcgagtgtactgaaaggactattatgttgctcttctcatctacagctatcagataaattcctttaataaaccgcatgtgtttaatttgaggtcgattttttaacgtaaatacgacctctatttgcttttgcccataaacatgtatctccccagcagtagttgcaactgccaaaaggctttgagtatagtcgaatgtggtaacagtgattcgtccatttatgccgtatgtgcatattttcttagtatcgaaaaatttggagttaataccatttgagacgtcatgaactctcgcggatttgatagcatttgacacattcttcaaatgcctgcttttcttaaacatttataaaatttttgtatctgttcaattgacaattttgtaacttttataatctgtcaactttagaaatatgttagtagtaatataatcctgagctgtttcttagatgcttccttaataatgtaaacagaatgcgcattgttgaacatacggcttcgcatcgcatcgcttaaacgaggtttttcatatgcatgctccaagataggtacgaacaaaaaagaggcattgcatcaaaatggatagtttcagtttatgtaacaaaatctcattaaaaaaaccctctcctcctatgaagcggaacagttcaacttttccgcttagatgttttatataaaattaaataaatcatggcatgaccttttcttcataaatccaaatcatctggcataaaggaaaatcctctaaactcttcttgctggctcgttgtcaaaacagagggcagaggtgtaagtgtgggtggcgcagaggtgaattcttgctcgaaatatgatgtatcttccggagatttaatttctgggatgtagggtggtttcacgcgaaggtttaagatatcgtcaaagttgatgttacggaagaaaggttcttccataacttcgtctgcgtccctgggaccagcacccaacctcttttcaggatcttttgttaataggccttggaatatttgtacaatctcacctgccatatctattgggtataagggttcatcggtaaggatagcgttaaaaacttcatcttcgtcatctcctgagaatggagattggcacagtagcatttgatatagcagcaccccaaatgcccaccaatcgacagctttggtatattcttgctcttttaaaatttctggagccataaattctggtgtgccacaaaatgtagaagttctattaccataccacatttcatctttacacaaaccataatcggcaatttttatatgaccttctggagttaatagaatgttttccaacttcaaatcacggtatattacaccattatcatgaaaatatttcagagccagtaagacctcggcggcataaaatttggcccttcttacagatagtctttggttttgaacatgccacattaagtcaccgcccccaataaactccatagcaaaatatatacggttttcagtttgaaaagagcagtatagattggttaagaatgggtgtttagtttttgtggctaacaaaaatactttcttttctgctcttgcactctcgatgtcatgattttgaataatattatctttcttcagaacttttatggcacaaagcctgtcagtattctttgatttagataaaataactttaccaaaattacctttaccaagaactttgagtaatacgaaattatctaatgaaaccttacgacgtttagccgctctctttttatgctttgcgcttgtgctggtttgtgatttctgcggagattgttgatcagtggttctggagggatgagtacttgtaggagccaaggacactgtttcttgtagtacttcctttgaagcatggtcttgttcaatttgaaaggtttcactattcatatcgcggaatggatttgtgtgtgtggaatctattgtcaaatcagcttcacggaaatcatttttgttctcccagtctagtttctgtttggtctctaaatcaatgtgatcaacttctagatcctcttggatttccccactatcttgttttatttcaagttccatttcctcacgttgtgctttccacagttcaagttcatctctcattaaatcatctttagattcccaagtttgactatgctcaatagataaatcagtgagtcccaaggaacgtctattcgacgttggatccagtgttttctctggtgatgaaaattcggcggtttgttgtgcaccttctgtaaaatttaaataggcctcattttcatcgataaatttatttagtttctcacgcccgtgcgtttgtagtgaaatttttttatcaataataggatcatgctgcttagttggagaatctcttcctaccttctgaggcgaaggagttttatcatgttttcttggctgaggaggcaaaggagcgtttgccctttcagctaatttggatggggaaagatcactaccattggcagtaccaatagatgaccccaactgtgccgacggaactgtcctcttctttttctcttgattacgttttgtgtcttgaatcgttttcagaattttattagccatttccatcgacatgccacagaaatcgggaaccaaatgagcacattgagcatgacacattataccacattcagaacatttgcgtactttatgtctaccccatggtaaaatataaccacagtgacagcaccatttagtaccacggtttgaagtaggcaggaatctatgaggaatacggtggttcaactttgcctcgtccggatccgtatcagtagaagttttagcaatacacttagtaacaacattggtgtaacattttttgtgacataaaaatttacaatcttgacattggaacccagtataccgaaggaaatcaccacaatatgcacagcacataatgttgtaaaatgatttttgtacaaagtggtggccatgctgttcgaatatctcttctttcctattgataatagcaccatgacgatgtagtccacccatcaactgcttcctttctatttgagaagacttgtggaatcctagtgttaacaaaatctgcccggatggttctaagacaaaccatgaattcgtactgatttgactagttgatgtattttcgccttgcacattctttgctgaagtagactgaatggctgagtttgagtatgtagaagtcaatgtgcttccctcttcgctagcgagagaagaaccaccattaatgtttgaagcgttgacccatccttgttgttcatttgtttgtccggctttcttcttacgaatttcttcagcgatatcggaaagcagtaaccacattatagccactggaatgagcgagtcgttcaccttatcatatacagtaatctcgatttcattccctttttcaactggaatttgaaaatcttcactccacctgtcatttctagaaggcttcgttctggctttgatcgtatcatcgatttttatagtaacgtagctctctggcttcctggcaaacatcggtgattgtatatggtcaacatctctagcagcagttattccaattgttagaacgccagtcagttgttttcttcggaatttcggttgttgattatccattatgtcattgggttggtgtttaaattgatcaaagtcaacgttaatagcttggtatttcttcaaagctttgttaagcatttgaatcctgtatttggattccatagcacccccttctgccgcagaactactacgttgatcaccgtcaatttgatacaatttagtcaatttagtattggcttcttggtattgcttttccacctgtaatttgaattctaattgttgcaacatgtattggattctttgcgccaaagaagggcaatcatattttactaaatccaaacgagaaaatatgtgttcatttggcgatttggtagaaagaaacccgtattccttcgaattgaatcgctcattatcttcgctgccattttcaccctgactttgttgagcggtcttcaaccgtaatttttttaagctatcctccaagtactcaagattttgacgtgcctctctaatattcgtattacatttctgaatgaccataacattgctagtctttttcttgagggcagaagctccccgaataatattttcttcgacggctatcttttttttaatgttctgctccaattgtgaaaaactcatgactgtaaactgctccctatatgtgtgatactatacttacttttcctcgctagagcttctctccgcagctactgttctaggttttattcctattgattatctaatatagttttaaaaatctatactgaaaggggatcgacgctgaatacctctaacgtaagtgtggacgagtggtggcagagacttttacaatggttaataatcagtctctactcagccaaattgaatagcagtgaaatcgtagctcttttactgctcctgaacctgtcgtattactttcgatagagtagatcaactttattatccacgcttgttaactcttttcgtcggtttttttcgcctttaaaactaggcgggctgggtaatgaagatagcaatgcctcataaatacaatgttatactaattacgttttttctttggttatgtatatatattgtgagaataaagagaagttgcaagatttggtttattgtacaatactacttattacactggcaggtgcaacctggagtgggacaaacattatgtctgtcaaaccattcttcagcgtgaccggcatgcataccatggttgcaactcaaacagaagctgaaccactcgttcaacttcagttttctacttacgagttcgcgatttgcaccatcttgagagtcttctgtctgcattgatcgcgtgattgcgtcccatttattacaaaaggtaagtttgacgttcctagaggcatgagacatatggcacatcttggaaatgaagacccacagtgtgggcaacaatacttatgtcttggcttttcatcagctgcttgtgcttcagaacttccagtattaaatttcttgtagtcagcgttatttcttctataggcttcaccatttttgtaatttccagcactagtagagacggcgctagaaggtgaggatgtgcgcggagtgttgatgttttgtttacagttttgacattggatatatatttgccggggctttatgtctgcagttaatacaccagttttagttctcgataattttgatcttaaaacatcgaacctggctcgcatggagaataattcccacgatttaagcatatctctataagtttgtatccattcatctactcgttggtcgcggaaatatctaggggagccgaaaattgatatcagtgcggcactctgaacatcgctggttttattaacgtatgattgcagtagatcgataccattaggtgttattccggtgagaattaaaccttctaattcgccgttttcaataactgtagatgaagttctatctaagaaagtggttaggtctgtatcattcaaaaaccttagagctacccctaatcgttctctcaaagatatggcaggttcataaagaatatcccaccaatcattgtctgcgataaaggcgaaaataactctcaagtaaggatcatctaattcggaggacatttttctgcattgctgcctccatgcattgttacctggcagatccttatacgccaagtaacctgcaatagcggtggcaattagtctcaatctttccttttttgcagatcccaatatttctacagcctttgggatatcaccaaaaaataccgcccaagcggcagctttttcataatggccgtttttcataattatgttgtacttgtcttcataatcagatctggaaaggtcccatcctgagataattaaacagagtcttctctgaacgtactttggtgaaccagcggcattggcaataggactgttccgatccctatttttccttcttagtttgatgattttttccatttctttatttagttgtttatcagaaagaattgtctcttgtctatatctgtcttggttcgatattccgtttataccattccaaatacctatcacaccttcgtaacctaagtcaagatcaccagaaaccatcgtaccatcgtcaacagaagcctttgcaatcgcgatccacctccatgtgttccttatataagcattgttttgtagatttttagaagaatcaatcatctctaccgtgttcattggatccaaaccatatcccaatgaagctcgcgtcctcattattacacttatatctttttccagaagtttttctggcttccagaacagttcaaatccacgcttactgtcaaggacatcattactcccttcattttcctcttcactcaactcggagtactcaatttcattattaggttcatcatgtccagacggaaagtaatcttcgctaacatctaaatcctcaaacgatagattctttaggattgtttttacattctctaagttggacttttcatgctcattgttgactctaatttcatctatctcagtattttcaaaatttgacaataagagagagttcctattattgagtatagccttggagcatacctctgaaattggcattctgtatattgttcccgattgtctcatacagattagacttgttccattattacttcttggaatataatcaaatgtagcaactctatcgtacatcgtatttgtgtcatgcacggaagaaacaaacaaattctcaatattcatctcgttatcgtcatctgccgcaatatcacgattgctatcgcagtaatagcctaacctccatcttttgatggtatcacctctatgtaaggtggcaaattcattgttcctcacacatgaccacctaaagcaagagttcatgtatttccttgacgctgcaccggatccaaccaatttttcaaaagttaataaaggggaagctacatttaaatcaccaagtgaagcttggtcagataattttctcctatcccaaatagctaaggtcccatcatccccataagtactaaattgccaatcgttaaacgggttcagtttgatatcatacgtcaatcgtgtcggatgttgataaattgggttgggggatctgacgtcaatttctttcaaaaatttcgtacttgcagccaatacactggtatcgttgaggaactttagggatactatgctttcatttgtgcaataactaaacattgggttgatagtttcatgcgaatcatcatgataattcatgtcccaaatttgtaaagatgaatcatgcttatttctgtcaagacccattgctataagaccattcgtatttattcccagagagtttatacaccgctgcttctttgctcgtacacgtatatcataattggtttctgaaacagggtacccttgggtatcctttaaatttgagacagatccaactatattttccgcctgagctgccttaccaccgctggcatttgtcatagaagtctcgttattggcatttaagcccactggcgcatggctcgctggcgatgaggaattttgtccagagatattaaaaatccttaaatatccattcttttcaccaactccaatcataccaatttctgattctgaatagtctaagcaggtgatactgccgaagtctttcacagtgtgtaatttaataattgattcatcagattcattttccggatccactttatagtgggtcacttcatctcttgtagggttcactgaaagataatcaatcaaattatcatatgaccaatgggtcactttttgatgagaccatgtttattcttctatacgttcgtgatactgcacttacgactaccagtaacatcagataccatagagcttatgctatcttgaatatatcatcgccgtaaagtatgatgtgtagcgcattagtcttctgcattcatattatcagtggtataccgtttggtatatgctttccaatcatgaagtgttggctctactctatataaattcgacatccattgattttctcaataaatgagttacccaagtaagctttccattgatacaagtgatctacattcttgcgacgccaaattataaagcactaaaaatcatatcatacccaattgcgggcagcacatgtatatattatacactacttataactaaccttcttcatatataacaatatgcctgataatactaatgcatttaaatcatatcatgaaagaaaattacatgggttttattgacataattgcatttagaatacataaaattctaaagaattaatatatccaaagtattagacataaccaagaataatagtgaataattttagattttgttacatataattctgcttgcctatctcttccactcttttcaaaacgttgcatgtaagcgttactaatattccgctttattttgttgcaattcctaattttttcattacattatcttgcgagtacggaagcgattaacgttctcccaatagaaggaacaaacatagatattgaagttttactgcttttgcttacctgacctttttcaaatttaattttttcccgctaataagaccataaactaccccgaaccaaattctaaaagatagtcagctggattagagttgtcatctccaaacattaattttgcattatcttcggcttcaatcaaatcgcctgataagaactcctttaattcttcatgaatgtttgtatgtggatgactctccatagtgccagcatgattgtggttaccgaccgaatcatataacggtggctcccaattgtgcaattcagccttactattttgttcattcatcaaagcatttgggacagatctaatatctataattctttcctcactattctcgctattattttgccccgaactggcatggtggttattggtaaaaggagataatgctgcgacagaacttttcttctcttccaattcttttatcttcgccaataacgccttcttttttcgtgcttgtatttctaaaatttcggccaggtattgtaaatattcgaccgttctatccaaaatgatacccttatttggtttgatttgtttacctaggtcatcgtaattcaataaagatggtggaaccaactgccgagttcttttatcttttgctttattaattctcttcttctcctttcgacggcattatgaaactctcttttgcgcctcagtttctcatcagaagttaacccgcctaaaatctttggaacacttccaggtcctatattttcagtcatattgctacttattgaagtgtgtcttgttctgggtgtgtttatgctaccatgcctaaaagaagatgaaaggaaacttcctgcacgaaatgacgatgatggtgatcttacctttggggaatatgtggaagatacggatgctgggcccaagctttgtggattataagaaaatgatgatgaatatgtgtttggtgtcatcatatcagaattgatgctagaagataaagaggagctcaaatcatcagttaagttatacattgtgtcatcggtgccatgctgaaataaaaagtcatgtggtaactcagcttttaagccttcttgttgctgtaatggagtattcattgctctatccacaggtgagtcgtaagccatagaataagatgatctcaagggaccctgccctatggaagatatggaattttgagtgacaggtctaccgccttggcttgttctaaacatatcatccaggtaagacgattgcgattctgcttcctcatatatggtcgaagctgtaggagtttgtgaattggacctcgcttgactgcccattaagttattattatcgttagagttgtgcgtattgatgtatgagagtttttcatgctgttgggcaggagtctcaccacctgggtaggcacttccgtgtatcttgtaatcatcattgtggtgtggagtgggtgtcactaacgaaaaatctaaagtttcctggaggacttttgtctggttcattaattcgtccagtagacgttggttctcagcctcactttcgttattgttcatcattcttcacttatttaagaagtaggttcgcctgacaaaaaataagagtattctattaaaggatacttgtcaactaagtaatgtgaatgcagtaatgtcgtttttgttatcttatatatgctcacgtaagacagaaattcggattgtgaaaaattccttgatgattccgtgcagcctctagccaaaatagcaactgcgagtaaaaaataatgtactaacctgcagtaatattggagatcctactgtccggaccgagtagtacaattgttagtttctgttgctcataagaaggcttttctaatcaccatggctttattatttcccaaaagtaacttgcgaagagtcacatcccgcggaacggcccgcaatcgtgacccggccaaaggcgattgtaatgaagagggagtattggtcagacttgtactatactgaaataggaagaagattgaataaatttgcattctaattgcgttcggtagtttagagtaggacttagattacctgtattgtctgcagttgcgttttttttttttgctggtaaaaaaaaagaacaagtgtggagaatatgagcgaggaaccaccttctgaccaggtcaatagtctccgtgactcattgaatcgatggaatcaaacaagacagcagaactcgcagggttttaatgaatctgcgaagacattgttctcaagctgggcggattctctcaataccagggcccaggatatatatcagacgttgcctgtatctagacaggacttggtgcaagaccaggagccgtcgtggttccaattgtcaagaacggaaagaatggtactttttgtctgttttcttttgggtgcaacagcctgtttcactctttgtactttccttttccccgttctagccgctaaaccaagaaagtttggtttactatggacaatggggtccctactatttgttcttgcgtttggggtacttatgggaccactcgcgtacttaaaacatttgactgcaagggaaaggctgcctttttcgatgttctttttcgccacatgcttcatgacgatttatttcgcagccttttccaagaacacggtgctgactattacatgtgctcttcttgaattagttgccgtcatttattatgctatttcatatttcccattcggtgcaacaggtttgaggatgttaagctctgctggtgtcaattcggcaagaggtgttctgcgcatctgaattatcattcatagtgcatattgaattgattagttgaagaagaaaaataatgtttatgttataagaaacaataataaagagatttataacctaacctaattaaatagcatgtagtcaacaaaaagggagtaaaacatgcagtggctctatatatataattatcgtagaataattcaaaaaaaaataaaaaacgaaaaaattcattcttcatcactcatcaaaggcactatttcgtcataacgcggaggctcgttaccatgagagagtagcgaatctgcggagctcgaacttactattccttcttgttcttcatcatcttttacattcgctaaagtgtaaccctttttgaaaaattcgttctgtttgtccttagagttttcagtggtagcgtttggaatcctcacagtaccatttgcttgtgataagccatttgttggtgatgaattgtgagatctattgacgggcgatggagtgctcaataatttatcgagattattgaatcttgacctgtcattcactgacgttgctcttgctctagcaacaccttggccactattgcccgaaacaaatgcggaattcgaaatactgccgttcatggcattggcatttgaaatactgttccgattaacatttggcacaccggcatcatcgcttgtatccggatggccactaactgacgtagttcttgataagttcaattgttgaatagatagtaaatcagggtcatacgaggccatgatattaggtgatcccatcggtgagacaatgggagaagctggaacggatatggcttcttcaaaagttggcggaggtggacatgtgttaccaaaaaagtcgctgttcatacttagaggaacctggttgcctttgccttccattgtggccatatcataagtgggtaactccatattaccactgttgcactgttcagacaccaggaatatgggcgtatcgattagaacctcataatgtcttaatttggacggacactcaggatcaggtttactgattcgtagcataatttccagcttatgtctacagtaaacattactgaagtgtaaactatccaagtacaagcctcttttcggtgtgtttaatctggtatgtgttttcacgggcaaaccagaattggatttgattattgtttgatggaattttggatcataaacaggtttttcattttcttcatgacttttcgagcctttatgaccggataaaaagcctattacactgggacgacggtgtgagggtccattggctacggcatgttcgggattggggatgctcgtgtatgcatcgataccataaggtggtattatctttgcggttcttttatccaaatcttcgtatttggggaacttcaattttgtttcaataattattggttccgttataccgagcctttctttcggattgccttttgaatcgctgtcgtcatcaaaaggactataagataagagattgtcattgaatgaattttcaacaatttcctcccttagagctctcgtgcccttctccttagttctgatttcaaataatgatacacttctttcctttcttctcttggaggcgaaatctaaataatacggattataagggtctttagcaacgggatctgtttgatcatactcatattcataacctttactaacaaatgtgactctttcagtaatactgacatgaatacgtttaacacaaacgtttttgcatatcggtgccaattttatcttgattgggacttcactgtttagtgaaacgtatttctgagcaaaggaaatctcgtatgacaaagaatctgtccaaaccctattaatatagattggtttattcgcagtggatacggcaacgggcggtggagttctaataacttttattggatactctgcgaaaatgtcctcttctcctgattcttcatttttcagttgatgtgagctcatgtgtagatgatttttaactttactaaacaaagtgttgcttatcctcctatgggcctgagcggattctgtttcggtaagttttaatgaagatgtagtggagcttagtgatgaagaagagtctggcgacacaataggttgcggagagtttgaatcttgacgatagaaaccctttctattgattgcctttgttgcaagccttagtctgtaactaacacgtgcagagggtaaatagatagtctccggaatatgattagagaaaaccactggtactaagaatacatagtctccaggttggtaaagatgagtcttatttacgtctatggcgtttaaaaggctggcttttgttttagtcttgtccaaatacagtctctcctctgtaggaatattcttgaacaacctcatttgacgatcgttggagttgttttcaatcatttgatcatctggggatatgcttaatggtacaaacaaatcgaagttttcatcattcaaattccatttcattgatgcagcattataaaattcttcattaaacgtctttgtaggaggaacacctgtattccaaaacactttaacccttgaacataattccaattgcatgtccgtaaatcgggttggttttttaacggatactataactgctatgctgtaagagaccatggaactgtcgatttcaacagaccttgtattaagttccgagccggagcctggatggtctcctgaattattttctctcaggagtgtgtctctattttcatttatgctgccaccactttcggtagccgctgccgttgtagcgagagatggagtgttaccttcttgctggtctataccatccataaaaaaatccgcctcagcatcgtccgtaccatcattgagtccgtttagtctggacaggtactcatcgtcattcgaggatatcgttggtaagaaaacgctttcaccgcttgtagaaatagaaatcttcaagtactcattggatagaacggtttttgggcccaggagacctctagcggttaaatattctatgagaaattgctcgttaaactttttcgagtttgccaaccttgttagagaagttgatgataaatcgcttgacactacagctgatgagttatggtcatcatcaaaatctagtactgtgctatcctcctcaatctgtgaatagcgtcccccagagattctgggctcttggtctaccgacaatcttcccgaagtgcgacggttggtgtcggaagtcgaggatctcggagtcgtagtagcactatcgctgatagagccctgtatggcagtggtactgtgtcgccttgcgtttggcggcggctgtttgttctgttttttgccaaggagttgggcgtctgtattgctgcttctgatgttgccgttattattgccgcctttcgttgtgttgttcaagacggcaggtgagtgaacattagcgccaccaagtaaagatgatagcgcgtgcctaatggtggaggatcttcttcgttgttgcatggaccctaatttcttggtgggagagggttgaaacggctgtcctttagactggtttaaatctgtttctgataaagagtgggatgaatttttcgccaccgtcttgatgttataaacggcatgccaataggtagagaaaaatcttgcttgttcttctctatttaaaagagtcacctttccgatggaccttcaaaaatataaacgtggcttatctcagagctaagacagaccttccgagcaataataatgagtcgttctattttttttttctcgtccctttttttgtcccctcttaacaaaattagaaatataggcgggaaagtggagaacccttggaagagtcagatcagagattggaaaaattaagaccaatggatatctacagatcctgtgaatcgagtgtgagtgatataccgcaagatcggtagaaaactgtatataaagcaaagaactgatgtggtgtaaacgatgtagcgatgtaacaagagatactcggtaatgtaatcaagatgctctttttttttttttgcggcaatatggtgtacgtaaaattaaggttccgtggagtctgtgcttgcgaaaatgatattgacgcatggactgtcgaaataataaatttacaattaaacacttggtgatttgaatgtaatttgaacgtttaaaaaattccaagggaatattactgtttcgggaatataacgtttgatcgctagcgcacccagatgagaatccgcatggatgggttgttagtatttctattgtgaaaccgctttgttctggagggcgagaaaaagttacggtcactctatcttttttataatttggtctaacaaacttgatatcagaaccacgtagaagaaaaagagactaatagtaaaaatatcaagaaagttgaccaatttttgttatatatgtccgtaaaagttatgacttggcactggtcttggtttactcatcaatcagctaggatcagcgctgagtgactgcttgcggctgggcggctaagaaatgggaatatgtacagtacaaattccgaactttgcgagcctgcctcgatggttttttaaggtgttcttttcttgcataccaaagcgtacacttgatgcgccgcttgacgttatcttgttctggatgaggccttatttttggtcttcattgttaaaacaccctattgtcatttagcagccgatgcgatgaacgaaactgcgaggtaaaagcgctcaaatcaaaagtgtagtatgaatgatatataaacaacttcaataaagtcacgcgtagttaaaatattgttagggtaatatcctgtgtccttcgaatatctgttggaataagaagcaacatcatctactgactagtattcgtgatactagtattcaatcacgtaaggtggaagagaatgacatgaagattgagaaacagtgatcaaactcaataaagagctgaatacaagcacatataattgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagattccctttcatggattcctaaatccttgaggagaacttctagtatatctacatacctaatattatagccttaatcacaatggaatcccaacaattacatcaaaatccacattctctacatggtagcgcctatgcttcggttacttctaaggaagtctcatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgactccaaacaaagctatggcttctaactgggcacattaccaacaaccatctatgatgacgtgttcacattatcaaacgtcacctgcgtattatcaaccggacccacactatccgctgccacagtatatcccaccgctgagtacttcctcacctgatccaatcgattcacaggatcaacactctgaagtacctcaagctaagacaaaggtgagaaataatgtcttaccaccacacactttaacatcagaagaaaacttttatacatgggttaaattttacatcagatttttgaagaactctaatctcggtgacatcattccaaatgatcagggtgaaatcaaaagacaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacggtcagcacgatcattcaaaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcaattaatatatgacgaaaataaaatcatgaatctaaataaaccgtcccaatacaaacaacacagcgaatacaaaaatgtttctcgcacatctccaaacacgactaacacaaaggttacaactcgtaattatcatagaacaaatagttcaaaaccaagagcagcaaaagctcacaatattgctacatctagtaaattctcaagggtgaacaatgatcacattaatgaatcaaccgtttcatcacaatacttaagcgatgacaacgaacttagtcttaggccagcaacagaaagaatctaagccaacacacacaatagactcgaatgacgaactacctgatcaccttcttattgattcaggagcttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactgcacacaccaaacatagcctatgatctattaagtttgagtgagctggctaatcaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaagaatcggatattgaatggtctaacgctagcacatatcaatgtcctgactgtctaatcggcaaaagcacgaaacataggcatgtcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtctacccattacacgaccgtcgtgaagaatctatactcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaaccaatccaaattggaccaattcaattatgatacactcacctttgatgatgatctcaatcgtttaacagcccataaccaatcttttattgaacaaaatgaaacagagcagtcatatgatcaaaatacagaatctgatcatgactatcaatcggagattgaaataaactctgatcctctagtgaacgacttctcgtcccaatcaatgaaccctttacaattagaccacgaaccagtccaaaaagtacgtgcactaaaagaagttgatgccgacatatctgaatacaatattcttccatctcctgtacgatctcgtacaccccatatcattaataaagagagtaccgaaatgggtggtaccattgaatcagatactacttcacctagacactcgtctaccttcactgcacgaaaccaaaagcgacctggtagtcccaatgatatgattgatttgacctcacaggatagagttaattatgaacttgaaaacatcaaaactacccgtttgggtggtacggaggaaccatatattcaacgaaatagtgatacaaatatcaaatacaggactacaaatagtacgccctcaatagatgaccgttcgcccgacagtgactctactactcccatcatctccatagaaacaaaggctgcatgcgataatacaccctccattgatacggatccgccagaatatcgatcttctgaccatgcgactcctaatataatgcctgacaaatcctcaaaaaatgttacggctgattctattcttgacgacctcccacttcctgacttaactaataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgtataaatctaattgcagcaataaaaggagtaaaatcaatcaaaccagttcgaacgaccttaagatatgatgaagcaattacatataatgaagacaacaaagaaaaagacagatatattgaagcttatcataaagaaattaaccaactattgagaatgaacacttgggatacaaacaaatattatgatagaaatgacatagatcctaagaaagtaataaactcaatgtttatatttaacaaaaaacgtgatggtacacacaaagccagatttgttgcaagaggcgacattcaacaccccgatacatatgattctgatatgcaatccaataccgtacatcactatgcactgatgacgtcattgtcaatcgcattagacaatgactattatatcacacagctggacatatcctctgcttacttatatgctgatatcaaagaagaattatacataagacctccaccacatttaggtttgaatgataagttactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattgttcagcaaagacttaaatgcaaatgagaaaatcataacaacactcaagaaacaatacgatacaaagataataaatctgggtgaaagtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagcgctccaggtcaaccaggtcattatatagaccaggatgaactagaaatagatgaagatgaatacaaagagaaagtacatgaaatgcaaaagttgattggtctagcttcttatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctataccgctattgaataacctcagtcaccttgtgcaagaacttaacaagaaaccaattattaaaggcttacttactgatagtagatcaacgatcagtataattaagtctacaaatgaagagaaatttagaaacagattttttggcacgaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacacaaatgatgagaaatagtcatctaaattagtggaagctgaaacgcaaggattgataatgtaataggatcaatgaatattaacatataaaatgatgataataatatttatagaattgtgtagaattgcagatcccctttcatggattcctaaatccttgaggagaacttctagtatatctacatacctaatattatagccttaatcacaatggaatcccaacaattacatcaaaatccacattctctacaataatagaataatgaacgataacacacactatgaaagaagaataataataataacactgtatagaaatagcggctccctcttgtttattctcacatcctcgagcaaaacttctagcaaatcctgtgtatttaatattatggcctctatcagcaatggactcccaataattatccaattactcaccaatttttcaatattagtgtagataggaaaggatcctcgatgaaatcgttatggttagtgtctctgttgataattagaggttaaaaattagtattaatgaagaagtgagtactgatcttcttatactaaataagagaggtatataaaacacacgccgattggtcatattaattatgaccaatataatagtgattccggtagttactatacattgatgtgacgactcatattcctcatatatgtacctaccataacatgttcaactaataggtctttaacacagcttcagtattgtctgagcttctcgtttaacattccttctgcaataggcgcaatcacacttaaacgtatacgagttgtacattaatatacgatgtaagcattagattgttaccatagcaactcatgtcactattaattactctcgttccaacagtctcgatccactgtgtgtattcttggaaaatgaacaaatcagtgtagagaagtcgtcttcgtttccatcatgagaatgtgcttcagtattactttttttgccttcaacgccttgattgttctatttttgctaataataaatctatttcatcggactaaaagtccattagttgtaagcggatttagctcagttgggagagcgccagactgaagaaaaacttcggtcaagtcatctggaggtcctgtgttcgatccacagaattcgcattcctttttgctagcattcttttttttttcatttctaggcctgtttctccgcgctgattggtcgcccgggtgatgcagttgcggccggccctggccaatcagatccctttaaaaatgggcccggtgcgcttctaccccttcacgccttttacgcctttttcgaatcttgtatttattgtaattattaaacattggtcatatcaaattcacatcagacttcaatttttcaattcactttctgaataagagcccttcccttcatacaagtagagatattatactgtcatagctctttcaattggtcttattagattgtctccatctttcccattgacgttgttactccctctcttttttcgtttttaactgatttctcatatattcccaaacaggcatatatactcgacgtcaagaaagaaaagaaaagaaaaccctcataaaaaatataatcgagaagtttttttcctcatcgcgaaccattagtataacagattgatcgttcagctctcataactatcgcaagaacagtaacaaaataaataaaaaaaacacgcacatataataatgttggctcgtactgctgctattcgttctctatcgagaactctaattaactctaccaaggccgcaagacctgccgctgctgctttggcttccaccagaagattggcttccaccaaggcacaacccacagaagtttcctccatcttagaggaaagaattaagggtgtgtccgacgaggccaatttgaacgaaactggtagagttcttgcagtcggtgatggtattgctcgtgtttttggtttgaacaacattcaggctgaagaattggtcgagttctcctctggtgttaaaggtatggctttgaacttggagcctggtcaagtcggtatcgttcttttcggttccgatagactggttaaagaaggtgaattggtcaagagaaccggtaatattgttgatgtcccagtcggtccaggccttttgggtagagttgtcgacgctttaggtaaccctattgatggtaaaggtcctattgacgctgccggtcgttcaagagctcaagtcaaagcaccaggtattttgccaagaagatctgtccatgaaccagttcaaaccggtttgaaagccgttgacgccttggtccctatcggtagaggtcaaagagagttgattattggtgatcgtcaaacaggtaagactgctgtcgccttagacaccatcttgaatcaaaagagatggaataacggtagtgacgaatccaagaaactttactgtgtttacgttgccgttggacaaaaaagatctaccgttgctcaattggtccaaactttggaacaacatgacgccatgaagtactctattattgttgcagctactgcatctgaagccgctcctctacaatacttggctccatttactgccgcatccattggtgaatggttcagagataatggaaagcacgctttgatcgtctatgacgatttgtccaagcaagccgtggcataccgtcaattatctttgttgttgagacgtcctcctggtcgtgaagcctaccctggtgatgtcttttacttgcatccaagattgctagaaagagccgctaagctttctgaaaaggaaggttctggttctttaactgctttgcctgttattgaaacccaaggtggtgatgtctccgcttatattccaaccaatgttatttccattaccgatggtcaaatattcttggaagctgaattattctacaagggtatcagacctgccattaacgttggtttgtccgtttctcgtgtcggttccgctgctcaagttaaggctttgaagcaagtcgctggttccttgaaattgtttttggctcaatacagagaagtcgctgcttttgctcaattcggttccgatttagatgcctccaccaagcaaactttggttagaggtgaaagattgactcaattgttgaagcaaaaccaatattctcctttggctacagaagaacaggttccattgatttatgccggtgttaatggtcatttggatggtattgaactatcaagaattggtgaatttgagtcctcctttttgtcctatctaaaatccaatcacaatgagcttttgaccgaaattagagaaaagggtgaattgtctaaagaattgttggcatctctaaagagtgctactgaatcatttgttgccactttttaatgtgaactaaaaaaataaaaatgaatataaggtacgtctccaaaagaaatgtaaatatagaaattttaaaaaaaaaaacgaaaaaaaacataactaaatttaaagtgcagcccaacaataaccctgaaaaatctaaatatcttagaatttttttattttgattattatatattattattattcttatggtaaataatgcccctacttttcttctaaggaagtgagttaccaccaaaataaggaaatatcgcctgcaagcggtttttattttggagttgtttttttttttcccacaatagcctctagtttattccattcttagcactgactcttttttccgccactatttcttataaaaggcccgaatttctggcacggacgttgtttttaataataaaatattgaatgacagttaaaaaatcacgtagtcagttaatctgtttaacttgaaaatatgtctgaatcagtggccattataggtgcaggattagtaggctgccttgcagctttggcattctccaaagaaggctacaatgtcacactatatgattttagacaagatcctcgattggacaccaccaaaaataaaaatttgaaatccattaatttggctatttctgctcgtggcattgatgctctgaaatcaatagatccggatgcttgtgaacatattctgcaagatatgattcccatgaaaggcaggatgattcatgacttgaaaggcagacaggaatcacaattgtatggcttgcatggagaagctattaattctatcaatagatctgtattaaataatagccttttggacgaattagaaaaatctacaacagaactgaagttcggtcacaaattagtcaaaatcgaatggacagatgataaacaaatctgtcattttgccattggggaagatttgaaaaccccacatactgaaaagtatgattttgtcataggttgtgacggagcatactctgcgacgagatcgcaaatgcaacgtaaagttgagatggatttttcacaagaatatatgaatttacgttacattgaactttacatcccgcctactgaggaattcaagccaaactatggcggaaattttgcaatagctcctgaccatttgcacatttggcctcgtcataaattcatgttaattgcgctcgccaacagtgacggctcgttcacttcaacctttttcggttctaaagatcaaatatcagatctgataacttccaagtcacgtgtgagggaattcttaatcgagaactttcccgatattattaatattatggatttggacgatgctgtcaaaaggtttatcacttatccaaaggaaagtcttgtctgtgtaaactgtaagccatacgatgtaccaggcggaaaggccatcctactcggcgacgctgcccatgcaatggttccattttacggccaaggtatgaattgcggatttgaagatgtgagaattcttatggcgctattgaaaaagcattcaggagatcgttcaagagcctttactgagtacactcaaacaagacataaggacctagtttctattactgagctggcaaaaaggaactataaagaaatgtcacatgacgttacatccaagcggtttttattaaggaaaaagctagatgctctctttagtattataatgaaggataagtggatacctttgtatacaatgatatctttcagatccgatatctcgtattctagagctttagaaagggctggaaagcaaacacgtatcttgaaattcttagaatctctgacactcggtatgttatctattggcggttacaagcttttcaaatttttgacaagagaacgttcctgaagccagtttattcttgccatccgtgtacgctaggagaggattattaaaataagtgatatatacatatatatatatatatatatatatataatacactaattattttatgtgatgttgatcacgcgaaacggtaaacggctctgttcgcgctttctttgtttacattttagtgaagtattgtcaagataatatccatatggttgaactttttatattggctagttaaatactctatttattgcaccaaaaaatcatcttagtggactttttggagcaaaaaaaaccagcaggtagttatataagatgactacacaactaaggtatgaaaataacgatgacgatgaaagagtagaatataatctctttaccaatagagatccaccatgatggcaaattttgaagaatggatcaaaatggctacagataataaaatcaattcccgaaatagttggaatttcgcattgatcgactatttttatgacttggacgttttgaaagatggcgagaataacatcaattttcagaaagcatctgcaaccttggatgggtgtattaagatttactcttcgagagttgattcagtgacaacggaaacaggtaagttattgagcgggttggcacaaagaaagacgaatggggcatctaacggagatgacagtaacgggggaaatggtgaagggcttggaggtgacagtgacgaagcaaatatagagattgatcccttaactggtatgcctatatctaatgatcctgatgtgaataacactaggcggagagtgtacaacagagttttagaaacaacattggtggagttcgaaacgatcaagatgaaagagctagaccaggaattaataattgatccattattcaaaaaggccttggttgatttcgatgaaggtggcgccaagagtttattgttgaacacattaaacatagacaacactgcaagagtcattttcgatgcatcaattaaggatacacaaaacgtagggcaaggtaaacttcaaaggaaagaagaagaattaattgaaagagatagtttagtagatgacgaaaatgaacctagccagtcattgataagtactcgtaatgactcaaccgtaaatgattccgttattagtgcaccttccatggaagatgagattttatctcttggtatggattttataaaatttgatcaaattgcggtgtgtgaaatttcaggatcgattgagcaactaaggaacgttgtcgaagatattaatcaagcgaaagactttatcgaaaatgttaacaacagatttgataacttcttaactgaagaagaattgcaagcagctgtcccagataatgcagaagatgatagcgatggctttgatatgggcatgcaacaggagctgtgctatccagatgaaaatcatgacaatacatcacatgatgaacaagatgatgataatgtcaacagtaccacaggaagtatattcgaaaaagatttgatggcatactttgacgaaaatctaaatagaaactggagagggagagaacattggaaagtacgaaattttaagaaagcaaacttagtgaataaagaatccgacctgttggaagaaacgcgaactactataggagatactactgacaaaaacacaacggacgacaaatcgatggatacgaagaagaagcataaacaaaaaaaggttctggaaattgatttcttcaaaacggatgatagttttgaagacaaagtctttgcctcaaaaggaaggacaaagattgacatgccgattaagaacagaaagaacgacacacattatttactgccggatgacttccatttttccactgatagaataacaagattgttcattaaaccggcgcagaaaatgagtctgttcagtcataggaagcataccagaggcgacgttagttcggggctttttgaaaaaagcacagtttctgccaaccattcaaataacgacattcctactattgcagatgagcacttttgggcggataattacgaaaggaaagaacaagaggaaaaagaaaaggagcagtctaaagaggttggtgatgtggtgggtggagcgctcgataatccgtttgaagatgacatggacggtgttgacttcaaccaagctttcgaaggaacagatgataacgaggaggccagtgtgaaacttgatttacaggatgacgaagatcataagttccccattcgagaaaataaagttacttattcaagagtttcgaaaaaagttgacgtaagaagattaaagaaaaacgtatggagatcgatcaacaatttgatacaagaacatgacagtaggaaaaatagagaacaaagctctaatgacagtgaaacccacacagaagatgaatcaacaaaggagctcaagttttctgatatcattcagggtataagtaaaatgtattcggatgatacactaaaggacatttcaacaagcttttgttttatatgccttctacacttagccaatgagcatgggttgcagataactcataccgaaaactataatgacttgatagtgaattatgaggatctagcgacaacacaggcagcgtcatagttgatgatctttttttttttttttttttttttttttgtgctgcaaagtttcttaaagccttcgggcttacgaaatcctttatcgccgaaaggggaccgcttcgaaaagtggatataaaacaaggtatttatttttatagacaatgaccaaatgacaggatagatcgagggtgagttccaatatgtccagaactattccatttctatttaaattagtcaacagggcagtaattttgcctacggcaggttttacattaggagttggtgcgtttgtaaaggcgtggcccgatgatgccggtgttctatcattgaatgatccgcaaacgccagcggagttgattagtgcgaccaagagccgccaacctatggagctgcagagggttgacatcctcgctcaaatcgagaaaagcgaggtttacaacaagttggcccaggatgagaagatgcaccatgtcttattcagtgagaaaataccaagcgggcatagggaatatcatgtaggacaaggcctcttgttcggcaaggggaagcttgaaattgatcctttggtgttccatgatgtgaatcacggtgaattaaccgtgatttatcacttaggtgctgagttagggaatcgagacggtaacgtccataagggcttgttgtcattgttgctggatgaagcattgtgctattgtggcttccctttgttgcctagtaaaagaggtgtaactgcaaggctgtcgctagagttttttgaggacattcctgtagatactacgattatactaaaagcaaacgtcaaagagattaaaggcagaaagtgtatcattgagggacacttggaacagtttccgttggaagtttcttctcgaaatggaactagaagttggaacttaccacatatttggggtttcaaccataagcaggagatggcaaaaaaatttgccaaggccaattgtattctcgttgagcctacttggttcaaatattttaaatggcttgatatgttttgaaaaagcatgcctgtctcaaaatagcctattccgtgttaattaatattctatattcaaaaaagttaaacatatatactgcatgtacttaccgccgaagcacaaacgtgccacttccatgaacacttgctctttatttatagtggggctgatatgcgatggcgtaaagctactccagcctccttcttttcatatcctcatgactgtcactatgtgttggtgtagccatcgaacttccactagatttgttcttccttttcttactattgttacctgaatttgagccggattggctttttcctgtaccgtctagatcaaacgccaagtcgtctatatcaaacggcgcttgggctcccccttggttctggtttgcgaactcgcttggatatgacctttcaaactgcgatagtaccgaagagcaaaggtcccaatcgaaatttggaggctgaaacaatgctatgtctctattgcgcagctgttcgcgccattgttgctctgacatgttttgaccctgctgaggtggttgtatcatcatgtctgggttattttggaaaagaatatgtgctatttgaccacctttaccattttctctggtcggtatggtggagaatttacctgaaagatctgctatctggttcttgtaagattttcttagcttcacggctttagtgccgtccaaatttgttcttgccacttgcctggagatgtcatccaagccatacaccgatatcaagtcctgtagaggatttggttgttggtacgtatatgtagtttccggatccacgtaatagtagtatgaggggactgtagtttcgtccactctagaagccattattatcgtattcctttttcgttcacttactattgctattcgcactcactacagatctatattttatgttccaccctgttgtcagatcaggaaaggaatgaagaggctctatttaaaccaaatacacctcttcgtttctcaatattgttgggctttccttttttttttccttccacgtctatctattgtctctatcaaaattaggaaaaagaaatgaagaacgatgagccaaacgaggctgagacaatcatgcatccgtacattctatgtatgtttgggtgtatctttccagattcggttctttttttttttcagtccaattgaaaaaaaaaaggaacaggaacaacgggtcgaaatttgccgtcacattcagagcgaagagcgacaggggaattggtgggctaaccacctgttgagcccagctagcagctgtcggtaaaccgtcgttgggcggggcgcgacaatgcagccagcggaggcattgtatggtttccgtctggagagtgggcttagccggcctggcactccttctctaagcagagtgagaagggaatctttttactggagaagagtgtttgattccagcagaaggtaatacgcacctttctcatctatttgcagaatcgttttattaaaatacttttaaagaatttagattttgataattagttcattctcttttacaaagataatcaccaaacagggacaatacactgaacgataaaagtatgtgacatatagaatgctagaatgaatagcctagactgcattgttatgagagcaacgtttgatatttgtggcgattggaacaaacatagtacatgccaaaatgagatgaaatgtccaatttgaactgattaacatacacgcgcaagctcgtatttgtttactggtacacctagagttagccgatcaaagagacagtggcagatatatgggaaaattttctccggaagattgcatgcgagagtctcataaccagtcatttcccaagatacaattctcggagctgttatactaacaaacttttaattttcatttttttttttttttgattagatggcctccttacctcacccaaagattgtcaagaagcacaccaagaagttcaagcgtcatcactctgaccgttaccacagagttgctgaaaactggagaaagcaaaagggtattgactctgttgttagaagaagattcagaggtaacatctctcaaccaaagatcggttacggttctaacaagaagaccaagtttttgtcaccatctggtcacaagactttcttagtcgctaacgttaaggatttggaaaccttgaccatgcacaccaagacttacgccgctgaaattgctcacaacatctccgctaagaacagagttgtcattttggctagagctaaggctttgggtatcaaggtcaccaacccaaagggtcgtttggctttggaagcttaaattaaataaagatttacaaaataataaccttcatttaattttaaatttcaataaaaaaatatcaaatcaaacatgacttttaaatctaccattagataattgtataaagtgatttattgttttttaattttgttttcattatctatcaaaactagggcattcttcctcacttttagtgataaacttttgtaaactcagtagtatatccagccgacgagcaatgcgataacggtgatgataagcaatgctctggaactcagactttgcccgttacctgctgatggcgctcttgctgattctgcatcgtggtttccagacggttttcttttcggtaacacggagtgaaatattttgatcttcttgaagactatgtcatctttgtactgctcttccagattaggccaatcggacaacagctcgccatcctccacgttttggtaagctgccgggataggaagtgtaacgatcaagaatttgtctcgtttttggtccatttcatcgtcagcggttgacttgggtaatccaaggaaaacaatttggacatttacactttcatgagcacctatgatggccacattgggcctcacacaatactttgtgggagcactagtcctcactttaaatataactctcttttcaccatcgttctcgagctttatatactctgttgattgtttattaaggggagctgaagtattacatattagtaacctgttgcatcgcaccaaaaaaggtagcaaagtttcccgcacactagcaattctcgtcaaacatacccttgaacaccagcttttctggcactattctcattgtttactcgtctgaactagtgcttatattatctgtcgtcataccactgtttgagacccccataggtcttatataaggtaatgcatcattctaaacgggcggcaagccatattaaactatctatataactacaacagtattcatatacctagtgaggaggccatttgaaagcgcattttacctcagtagtcatcacctttcgaaacgacttcctttttgtgagcatgcaacaagatggtgtgttcgaattgtgcagtgtaggatccggggatatcgttcaatggtggataatcctgtactaaaccgtgtctaaccaagttattcaacgcaaataagtatttctcttggccaagtctgtctaggtatcggcgacagaacggtaaagtcccaaagttgcggtctatcgtttttaacaagttcttggcgctgtctaacgtgggcattacctgatggtcttcagcagatctggcataatgagaaacttccccaccggcagtaacataacctctaccagtagaaccaaaagtttcaatggcaaagtgctcaccttcctccatttttgtagtgtccccatttttgacgatgggaacggatttaccgccgtggatacgatatggtgcgatactgtggccacatagattacgacaaggtttaacctggtaagtctcaccattgatttccacttcgtaggattccataacttcttggatggcttcaccgatgtcggttaatctcacatcgatacccgcttctttaatacccgtgtaagtagcgtcctttacagcggctagcaggttatcgtattgtggatcaaaggaaacagtaaaggcagaatcaatgatgttaccgtttacctgcacaccataatctaccttcatcacgtcttcgtatttcagaacggttttgtcgcctgcattgggtgtgaaatgtgcagcacaatggttgagagagagacccgttggaaacccaataccttgagatttgggatcctccatcgctaataaattttcggcacctgtatactttcttgtagtattttcgatcatgtcagcgatatccattaacttcatcccaggaacgattctgtccttgatggcccttctcacacgacgatgtatctcagcaccctttctgacatcattccaatgttcggccctttccagatcccttttcaaataacgtgattcttcaaccgtggttctttgcagattgaaatcttgatgatagtccatccacgcaccttctgggtactttccatctggaaacagtaattcaatcttcttcacattgcttttcttcttcttctttttcttgttcttcttctttttgctttctactgggtctgactcgtcagcttttgcctggtcttgctgttcaacgccttcattctccaaattcaattcttttaaatcagaagcaggggaattttctatttcagcgtctgtaatttttcaatacggtagagcttctacagtacttgttgatgtaaaagcccacttattagcttcttgctatggcttcctttcttttttaagttcgcttctttcccaagattgaaaataaaaaataagtgagaccaggtcattaaaggtcccttgaagagtaaaaaatctgtcaaatatcacccataagagcataaccataatgttgaagagcacgctgaggctttcaagaatctctctcagaagaggtttcacaacgatcgactgtttacgccaacaaaattcggatatcgataaaatcatactaaatccaatcaaattagctcagggaagcaacagcgatcgtggccaaacctctaaaagcaaaactgataatgcagatattttatcaatggaaattccagtagatatgatgcaatctgctgggagaataaacaagagggagcttctatccgaggcggaaattgctagaagtagcgtggagaatgcacaaatgagattcaattctggaaaatctataatcgtgaataagaacaaccctgcagaatcatttaagagattaaacaggatcatgtttgagaacaatattcccggagataaaagaagtcaacggttttacatgaagccggggaaagtggctgaattgaagagatctcaaaggcataggaaggaattcatgatgggcttcaagaggttgattgaaattgttaaagatgccaagaggaaaggatactaatcgtaccatcaactcttgaatattgtgaaattttcgccattgatttccgtctttgtaaataggtaatgcgtaactatttagttaaatttttgtatattttttattctatgacttcacttatccattatttccatcgtcaaaaaaaggaaataaatactgttgctcgaacgaacagcaagataaagtggaaacgaaaagtaagcagcttcctcaatatgccgtcaaacgtacgttcgggagtcttaactttgctccatacagcatgtggagcaggcgtacttgcaatgccgtttgcattcaagccatttgggttaatgcctggtctgataacgctaacattttgcggaatatgttccttatgtgggctgctattacagactcgaatagcgaagtacgtacctaaatctgagaacgcctcgtttgctaaactcacccaactaatcaatccgtcaataagtgtagtgttcgattttgccattgctgttaaatgttttggcgttggtgtatcttacttaattattgttggtgacttagtgccacagatagtgcagtcaattttttatcgtaacgatgataacatgagtggttcgcaagagcatcacatgttcttagacaggcgtttgtatataactctgatcatagtgtttgttatctcccctttatgctttaaaagaagtttgaattctctacgatatgcttctatgattgccattgttagtgtcgcatatttatctggtttgattatttaccattttgtaaatcggcatcagctagagagagggcaagtatattttatggtacctcacggagattctcagtctcattctcccctgactacattgccaatttttgtgtttgcttacacttgtcaccacaatatgttcagtgtaattaatgagcaagtggataagagcttcaaggtaatcaggaggattccgatttttgccatcgtgttggcctattttttatacatcataattggtggtacaggttatatgacatttggtgagaatattgtaggaaatatcctcactttatacccgaattccatctccaccaccatcgggaggttagcaatgctgctattagttatgttagcatttccattgcaatgccatccttgcagatcatcggtaaaaaacataattatattcattgaaaatttcagaaaaggtaagttatacgataacagagctagctttattccattagacaactttaatagtgaagatccgcaggaggcgccaacccaacaaaacaacgaagagccaaatctgcgtagtgagtctttacggcatatcaatattatcaccctttgtatcttactgttctcatatctactggctatttcaattacgtctctagcaaaagtcctagcaatagttggtgccacgggatctacgtcgatttctttcattttgccaggcctttttggttataaattaattggctcagaatttacgggcacgaatgaaagagtaccgacaagcataaaaatattcaaatacttaagtttatctctattcatctgggggatagcagtaatggtagcttcactatcagcgattgtatttttgggcacatcatcacattgagtttgtacattacttttcgtatttctataaacaaaaaaaagaagtataaagcatctgcatagcaattaataaaaaggtgaccatcccatatatataacactcaaatttgatggatccgtggcttgctgaatcaaatcttgtacgctagactctacacttagtccattacccataagcttctcttctacacctttaagggccctataagactcttggttttcgttcctgtcgttgttacttatgaacttgctgacgttatcgaaatttgtaatttcatgttcttcttcaaataagtgttcgtattttttaactggtgacattacccaggaataaaggggatcccattttaagatattcaaaacacacatcaccttgacataatcttttcttaatactgcgtaaactctttcacaactccgcctgaataggccatccacgcctgtgactccaaatccatcaacgatatctctagttaatctgaaagggaccaactctggaatggggagtaattttccctgatcaaacgcaattcccaggtctatatgaataggctcccctgttgagcagtcaagcaggatattgtttaagtgcctatcaccgaggcctaatatgtatccaacgatagagctagctgcgacaccttttgtgtacgttttcttagcttcaaaccaatccaacggatcgggaaaggaatcaaaaaaaaagtttcttaactgcggttttatttcattagtgatttttaaataagctttcagcctctcttcatttgattttgtttgaactgctttcatgccttttcttgcctgatcgaaggttatcttatcgttggtatgtagcttactcaaaatttgatgtaatgatgtagaatttgcgacaaattcaatgattcctgcctttggtcctaatggaaccactttgtatgttctaatacccagatctagatttcttaatactttatcattttgtagaactttattaacttgttgaaacacttgttccataattgcatcttgtctcaaatcgtcattacttcctttcatcaaagctttctgcgttgtaccatctgagatgttgaaggtgactattttcggcagggacaatcctgtggtagtaatgcctactgtttcattgacggatacaatataagggcgggcttttcttccatcagcagaacttttgactgtaaaattactggtcggtaggggaagcttctccatgtttagctgtttcagccaatattggccaatcttcaaattagctaagcgtaacgtcttcgtattttgcacaaacttaagattagctaactctacagacatctcgcaaaactcttgcacaggaagtaaatactttttcgcaaaggcacccctgtcatatccttgcaattctaaaagaatctttttgacagcttgaattttttgggatatgttggtgtccttattggattgcttttcatatagtagtatgctcatcactgaataaagggagtcatacggtagtttgtaaagaagtcgtttcatggttagttgcaatggcttttgaaattcattctcctccatagatatttttgacgcaatctgattgacccagggcaaaaacttccagctcggtattgttccaatttctttatatagtaattgattgatcttgctattgtcatcattctcgaaccataaaccacaaaacttatcaataatgtcattatcatatctgttgctgaaaactaaggtattgagatagaaatggagtgcatgccataaaaatttttctttttgaagaagcagtgcctttagtacttcagaatctctattatattgtagcaagacacgattataatgccttttcgcatcttttctttcattttctggtaattttgtgtttttatatatcagctccaaagctttcaaggtagattttccagtatatgacctatgttctctatcttcgatttctccatttgatcgtaacttttgtgcctgttcatccagaaaacttccgagtgtgtagaaaacatcagaacatgattcatgatcttcgacatttatatcccaattgacaatgattttttcatatattgcagcagctggttcaagccttgattctgagctccatttaactagtcgagctttaatttggtccataggcacattaatgagtagcttaaaatcgtcataaaggatactttcgctaatattcttctcattttgagctaaaagatctctcattatcattacaggtgccttgtactctcgagactcccagagggcattagcagatgtgaaacttgccaatttctcaatttgagatactacagagggatcatcgtataattttgcaatattcttcactgttttgctcattagagtggcatttcgtaacgcatcttgaggcgcaccattggcaattgccagctgaacgtaattagcaagctgaataatggatccaaggcgtaaatatttcgagcattttacgttttcatctaatgaattcctcgagagcacattcattaaagtatgtctactctttaacgttgttttgtgatcatagaagtctattgtattaagtctctccttatcggccttcataatagacatcaatgtttgggggaaggaagtaacgtcctgagggattgctgctatttttataaattcaataatcgcgttcagagtatccatccattcagtttggctaataaaatgttgtcgagaatcaaaaatagttaataaggatttttctaaacttttttcagcaaaaccaacgtcctgtggtaaattttttatggcatagtataaacctttggctttggaatcaacaacttttggagtcaatagcttccagtctcccaattctaaattccatttgtagacatcactggatccagaaagtctactttccaataagcttgtcaacccgtagaaaccgctatcttctgtggccttgattaatgattccttttcctcttctagtgaagtagtgtaattggcatcaaaatcggcgttgttgaaaagaaaacgtttccacgtatctgagtcaattctattgatagagttcaaaacaccctctattgagtgtggaacaggtaagcctgctagaaaatcgccgtcatttatgcattcgtaaatcttctgaagtgtatttatattcatttctcttatgtttggcatgttcatttcctcaaataacaaatagccaaacttgaactcttttattttaagagaaatttgacatatttcttgtaaatctaagctagaatatatgcgcagacagtttcgttccttgcatctagaacccatcctaatcattttaattacattgaaaagcatctttagctttatctcagaatctttaacatgcagcaacattgctatttgagtgaatattcgattgctccaattcaaacagcttttcggatcgtaagtcgttgaaagaaaaaagaggtcagtaagtactaattcacaaaaagctgttgatcctttgcataaaggatacaagcaaacaataggaggtatattaaatgatatttggtgaatcaaactacgggcgaatttgcttagccagcagttgtagggttcgttcactgacaaataagtatcgcatatgaatgattccatcccaaaattgtttgccaacgggtatatagcattcagtacatccttgtccaatggagcaactttatctttgttctcgttcattatgttatccctaaaacaaaattcactttcgctatttcctattgagtagcccactaggtacgttagaatgcactcagaaataaaaaacacttcagtagaatcatataactcagcttctttattgaaggtcgaaatacgttggtatatcatatgtggttgttcgggatggcgaaataccatttcaaagtttttcaaatgaacttcattattaaagtttgtagatctctctctttgaacttcttgctgtaaaattcttcttgaaagagcagcgaaccatagtttgaagtttttactcaaatattcctttggaacatggtgtttcaaaatgttaattgcagcagctttagaaagcgaacaaccgatttttgaagctaccggtctcctggcataagaaaagagtaaagaaaccaatacaacatcgtctacgccacaatcactagcatccaaaagttccgtattttcataaatatcatcttggactatatttccgaatattgcatcaaggaagtatttccaagtttttattttgatgagatcccgatgctctaaaagctttatagcctgctggaaggatggactgagctgtttgttttccctcaaataaatgaatattttgcaaaataaattgggcagagatggctctatttcaaacgtatttttgtcagccagatttaacaatgagctgaaaattgttattacttcatcgtgaatttgtgtatctattaagaattttgaaagccgaattatgatgaagtttaaagttgatgattttacaagtacattctcatacaacacaaaaagatattttaactcccttgcacatcgcagttttcctatgtaagtcgatgtcttttcaaggtctgtaataaccgataaaaacaaaagcttgaattcgtgtgtgttgttcttttcatgagcaaactgcgtctgaactaaggttgctcctaatgccaagggtatatgaagtgggtattgatacctcattgaaacactggaattttcaaataaatatggcgaaaggtatgaagttgggaataatttttcaacagtagatctaagttcagtaagtgagcccaaatcagtaaatcttatgatccactttaacatcagtagacggtattttttatggtattttactgttgttttacctgatatttggggcaatatatcaaatattagttcattcacaccgccactgataaaggcaagtggaatacacaagtaatagctgttatccaccagataagcatcaccgtttccagtaatcgcgtgtaacatgtctaagatccatttttggttgaaaccttgagaaaagtagattgcagaaatttctacaaagtatcttcctaaaaattcatgaatatcggcaaatccaaaaagagatatatcccattctttctccaatttagaagtagggacttttgttctgttaaaccagtacataatcaaatcaaacttacaatattcgaagagctctgtaaggttttggtagcgaaaagcgaccgtaattttgttcagagcttgttggataaacgcacgagtatgattgaagccagagtatgtcatcatatcctccaaagaaaaaactaagcttgggtaagacaccaaagacaacatggacattgcaagagagtagaaagcggacttttcaatactttgctgaggcggaccaaataagctcttaatctcataaaatatgatactttgattcttatagctcacttgggccatataactcgaaatactgttcattatgttaataatattggaggagtctagcttttgcaggcatttaataaaagttgcaaagactctctgcttcccacctctgattgatccgtgggaaagatcatgattttgaagtaggctaagcagcagcatagaaaggttgaccgtaggggccacaccagtgaaagaattgtcctcaaatctagatatgatccagtccaggatatcattgcagtccgaattcaaaggctgctcggggtaagataaccattgaggtcttattgcttcgatataagatgtaagtaaaagcatagcttgattggaagaactatagtggttgcaaagcaatttttcacccaagacttcagtgaattcttccaggattttgttgtaagaagatttctccccgattgcttgttttaaccactggcaaacagtgccaagataagatataaatacatctgtgctaacgcaatcagaaaattccaatatggctaccaaacgctctgaaatggatttatttcttgaagaccataggtaagctcgcactgctttatctatagtggagtgcagaggcttctgaaatctacctccaattgtgtacggactattattctgggtagtgtcttctgaagaggcttcgaagtaattgatggcagaagttcctgtttgagatttgtttttttgcatcctgataaaatcattaacgatttccttcatattaattttgtcaagcactaaatggtctacatttatggtccgtatcgataaaacctcctcaaaaaatgattggtaggagttttggctatcaaaactaagttgtggaatagttattaaggttgttctcttatatgctgcaataaactcagaaaaagtggaatctccacaaagattatcaactatttgtattaattttgctacccaagtaaatttttgtagtggagatgaaaatgcatcactttcaatattttccagtaatctgtaaagaatttcattataacgtgtgaggtctaaggaaacttttggtaaattaaaaaagggagtgttaaaacattctgacttttcttctggttttacgcctaaaagaaattccctctgctcttgaaaatgttgccaaatcttgtggctttcatcccaacatagtgagacaggattagctccttcgccttttttatcgttgaaagggttctctgggtcatatttgttacctaaccaggatataaaattgcagaactgatcctgtttagcatcagttccgcgcaactggttccactttgattttagccactcaaaaattctatcagcggacgatataccgttcatagattggaagtctttaccaacgtactgaaggtatccccatagcatgaacgattcattagtaactaatatgggacccaaaatatcggataattcgtaaagatcatatatctgattgatagttttctcatcggataaaagctgctttgaaaactttatggagttggctaataaaagacaacttaactggcaagattcatttgattttactaatggtaagcaaactttaaataggcgtgccatgtcgccattgcttaattcgcattctttttgggataataaaggaataaaagaaaaacaaacccaattaaagcattggattttttcgaattttgaaaacagaagttctttcagctgttctgcaaaacttttagtgaagtcttgtaaagttccataaaatgagcacaattgtaatcctagcacttcaaactcatgtgagctgttctcctctaaaagatgaataagaaatgtgtccatatcgtcagaaatccgtaggatagaaggtatatccgaatcacattttcttcttttaaataataatgagtaattttcattttttctgttcaatgcaaaatatgttaacaatgatttggtaattccgagtatttttaaccacaccgatctgcctcccctatctctaagtctaaaatcaggtaatgcaaaccatgaatttttatcccttgaacctcgaatatatgagaattccacatggtttacggtaaataattgaggcttataattacttaagcgcagtagaatgtactcacggtatagagatacaagagattcggaccgaagctcttcaacataattctcttgaccaatcatataaggaagtttatggttcattagttcacttgacataacatcaaacagtgataattggtcttgtactagctcattggaagtacagccaattgtcaggttgtaactccatgcttcttttataagcattagcgtatcaataacactaaaacaatggcacttcaaaattaattgatttattaatgacattattaatctcgtatttccattttcttttttgctgagcctcaaaaaatctattacggtccaagtaattgtccttgtcacttgaaatataccaactgtgtctaacgccaataaattcaggaggatcgatatgaaattggtcaatgttttgtctaccatagataatttcatttggctttgaaagtactcgcaaattttatcgactaaggatatccattggtgtatcatgaatttcagtttgaaagggtcacttttaattagggcatccaaagcaaacgataaatgtactgaaacggcatccaataaacttttggaaccatctttgaccattaattcaggtactactgctaaaagtaacttcaacgttttcactttaaatctctcacatgatttttctacaaataatcttaaaacgtacgatatcgtggagagtctgttctcactaagtgatagcttgtttgtggttgacactgtcaagtttcgaagaaggtcacagtattttgtgtgttcagatgcaagtaactctaccaaagcttctgccgttgtagatagggccttggttggtatcctttccggatcttcttttaaaattgttgttagctcatctaaagcattgtttctctctttgatttttgttgatgatagaaagtttaaagtttctacaatcccatgatcctccatcgtctatgttacactgatttcccttttctttgaaggcttttttttcgaatttcctgctttttttgcgaggctttgagaagtcaattagtcttgattattctattaacttggaactaatttaccttgaaaaatgtcaaaatatgcatattgtacggctggtgccatacttgtttctcactagcaaaacattctatcatctgttattcttaccttcttaacgtgtctgtttgcttttttgacgtaccccaaaaaatatatagaccctcctatcacgctcataatatcatgtgattctctcgatgaacgataatagtaatattttcatctaaaaatgcaatgaattattgagtttctttaatctgtttaagagattgttatttataaagaaaatatatataattgaagaatctaagagtatgagtcaaaataatttcctttttacacaacaacaccggagttagatgcaactcttggccataaatcggcacattccttaccgactggaccagtgatggcggaacccttcatttcacccttaggattagcgatgacaccagcattgtcttcgaagtacaaaaagacaccgtctcttcttctccaagacttagcttgacggacaacaatagctggcataaccttctttctcaattctggcttacccttcttaacggtggccataaccatatcacctagagaggcggctggcaatctgttcaatctggaaccagagcctttgacggcgataatgtacaagtttctggcaccactgttgtcagcacagttcatgatggcaccgactggtagacctaactagttaaaaaagatctcaatatcggggagtgagaataattttgttagtaaaagcatagggagaaagttagcagatgtggttaatcttgaaaaatagagttaagcgtgatttttgtagaaataacatttcgatggttatccattagtatgggcaaaagagggagttaggatatgcttgccgtgtatgattttgaaaccagaaatttttgagtccatgaatattgacaggtatcacttcatctgcaaatacagcccgcttaaccatttaaaaactgaatttatgtgtgtaattgcatctttggcggggcggtaccagtgatggcacatctaccattcttatggaaaataacaccgataggtatatgatcaggcttcacacttagtgtttagcgtcttttaaacctctgtttaattctgttgtacccagcaaaatgaaatcttggaactttactttatgatcaatttaaccaaattgcattgtggaaaataaaaattttaacatactgagattctaaacttagtaccttgagcaccgttaccggacattattagttatatataggtgtgttggttttgtattgcttgtaagacctaagagtcaaaataaagaaagtaagagatttttagctactaaccttagcaatacgatggtattactattagcgggaacaggtacattatggctacagttcgtttcctgccatattaatttttcagcccgagcgtgtttgggtttgatattttcttttttacctctttttcaacatttccatgcaagtctgatgacggttgtacggctcgttctgtgagccggataagcgataaaaaaacttggtctgttgaaaataataactgcatgggttttttcaaagcagttgggggtgtacagatgttaatgtagtctgatatatgctctgtcttgtctttttatctgggggatcattaacatggtaatagtgattggtattgcaagcttaagattataattacataaaacaatacaaatattctagcccgatggggttattatagaccagtttttgttttctcttattctatctgttaaaaagtccgtggggttattgtcttcgacagagttattatccttgtcgctccctttatcattagccgtattttcgttatcctcgtcattatgagtcctcagttttgcacgttgtgctcgtgacatatgactccaattctgctttttctccaaatactctcttttgcccattgtgctgtagccgtcatcgcttggatttggaggccaactacttgccttgttcccaaggttattgccataatttggattgtagtactcttcttccatttcgttcaatctcaatgcctgtaaatcgattaaatttatgcccttctcgttcttagcccaaccgtttccgccttgtaaaatatcttccacgcattctcttggcgtaaattcacctggtcgaggatcccacggtaatttaaacgttttctggtacaagctctcaatcagtgggctcatagaggaagatattgttgttgacagccctggctttgttgtcatttcgctactcttgtggttggtagaagtcggtgatttaatacttgtgctgtttcctgtcgcatttgtaccgggtttcgctacagttgttccaataccgttaaaattggagaatgtattcttgggtgacatctggtttgttgttgatgtggggctagatagttcagacgtgttatccagtatagtatttattcctggcctgtaattagcgagctggccattagtaaacgatttggaaatgttgaaatcttcgtaagagcctctaactagcttcaactgcaatgagacgttgattatagaattgacctttgagtgctttaggagaaatctgtttgttgtgggagtttcgtcttctttgacgtattctgttatatctatgtctactgttcccaatagaagtttacccgttatcttttgagaatatgaattgtttcctgtggccgttagtgcagtggcgttagcataggtcgttttcttcactttgccattgggactagaactagaagtcaacgaggaattcgcatcagcaaactcaaaaaaaacatccaacaccaaaattttcttcaagaatctgccgtttttatccaagtggagcttcaccaggattggtttgtctaatgaataattccattgtgctctatgatgttgcacatgcacgtgttttgttgtacctctactctgggtcgaagtggtttgatgctcaccgtccagagccactttgtgtcccgacgtacctgttccatccttcaaacgccatttcgtgtagcaatagccagaagattgaggaatatttaccaattctttgatttgcaggtccagtagaaactttggtctttttgccttgctattatgattaaatggcatcttaatattttgtgagcggtattatacctttcttgggtacctaatacttctaagcaacctgaatgaaattagaaggtgttcactccttcattagcaagtgagctttgccgttgtcaccgtacttggtcatcttaagagatacaaaggggggggaccctgagaaaacttctcccgaaaaaaaaaaaagaaatatacccacgcgttctttacccggaaataaatatcttgatttagccgccgagattgttatatatgcatccaagacctctgaatggtggctaattaagacacttaactgattacgtttccatcaactgctatcatgttcgcaatatttgggcaagaaatgaaaaagaaaagttaccaactcttctcccttctacgagcggtgaatacatgggagccgagccgcatgaagatgaaagtaatattaaaattaaagtctctatcgaagcagtgactctctccctatcagccggtaaatttttttaacgaagtggagctaaattatcagaaaacgtagagctggtatgctggtagatctaaacgaagtccagtttacatcaagatgatatcgtgcaatatttactacggcatgacttaacagtacagtcatgatttaggaatttgagtgttctccggggttttgcagataaaaatttgttttcttctctgccattcctggagattttgaaaagagttggtaatgtgtttcaaaagaaaaaaatacattccaagaataaataccaggatttcgtgacaaaaattaaaaaaaagggaagtatggcatgcctagaaatcttttctggaaaacttgaagcatatcatataattgtatgaacttgtccttcaaaagatgttaccaaatattcaagagtatgtgagctttctattctattgacgcgtaagaaaggctatcacgtgtgggggggagagctcagccacattgcactactttcgaaaccgcgtagtcggaaacgacattcccccgtaccaaaacaaacgaaaggacgtgaaaggtaaatgaataacatggcactaaaaatttggcagaaaacgaaaaaaaaaaggaaaaagaaactgaaaactatacgcttcccttaggatactttctgatttacatccgaagaattgggtgcgtcaattaaaggcaattcttcgctctatcaagcagttttactgcgtctgtctaaagaaacaattgttttactgaatttcaacaaagttctaactcgaggtgaccggaggccactgtaataataaaaaatagaagatgagtctcgaaggaaataccctaggcaaaggggccaaatcttttcctctgtatattgcggtaaatcagtactctaaacgaatggaggacgagctcaatatgaaaccaggtgataaaattaaagtcattactgatgatggggagtacaatgacggctggtattatgggcgcaatttgagaaccaaagaggaaggtttatacccagcggtatttaccaaaagaatagcaatagaaaaaccagagaacctgcacaaatcaccaacccaagagagtggaaattctggtgttaaatatggaaatttaaatgattctgcgagtaacataggtaaagtctcctcgcatcaacaggagaacagatatacatcattgaaaagtacaatgagcgatatagacaaagccttggaagagctaagaagtggttcagttgaacaagaggtatcaaaatcgcccacacgcgtgcccgaagttagcactccacagttgcaagatgaacagactttgattcaagaaaaaaccagaaatgaggaaaacacgacacatgactcgttattttctagcacagcggatttaaacttaagttctgaatctttgaagaatataagtaagtcaaatatatcaacaaaatccctagaaccgagttcggaatcagttcgtcaattagatttgaaaatggctaaaagttggagcccagaagaggttactgattactttagcttggttggatttgatcaatccacttgcaataaattcaaagagcatcaagtctccggaaaaatactactggaattagaactggaacacctaaaagaattggaaataaattcttttggtataagatttcagatattcaaagaaataaggaacatcaagtctgcaattgattcgtcgtcaaataaactggacgccgactactctacctttgcttttgaaaaccaagctgcccaactaatgcctgcagccactgtaaatagagacgaaatccaacaacaaatttcctccaagtgtaacaagttgtcaagtgaaagctctgatagaaaatcatcttcggtcaccacagaattgcaaagaccaagctcggttgttgttaatcccaattttaaacttcacgacccagctgagcagatcctagatatgacagaagttcctaatttgtttgctgataaagatattttcgaatcaccgggaagggctccaaaaccaccatcatatccaagtccagttcaacctccacaatcgccctcttttaataacaggtacacaaataataacgcaaggtttcctcctcaaacaacatatccacctaaaaacaagaacccaaccgtttattcaaatgggctaattccaaattcttcgacatcttccgataattcaacgggcaagttcaaattccctgccatgaatggtcatgactcgaactctaggaaaacaacactgacatctgctactataccttctattaacacggttaacacagatgaatctctacccgcaatttcaaatatatcttcaaatgctacatctcatcatccgaacagaaattccgttgtttacaataaccataagaggacggaatccggaagctcatttgttgatttgttcaacaggatttcaatgctatcgccagtcaagtcaagtttcgacgaagaagaaacgaaacaaccttcaaaagctagcagagcagtttttgactcagcacgcagaaagtcgtcttacggacattcaagagatgcctcactttctgaaatgaaaaagcataggagaaactcttctatattatcttttttttcttcaaaaagtcagtctaatccaacgtcaccaaccaaacaaactttcactatcgatcccgcaaagatgacttcccattctcgttctcagtcgaattcctattcgcatgcaagatcacaatcttactcccatagtagaaaacactcgttagttaccagccccttgaaaacttctttaagccctataaattccaaatccaatattgctttagcgcatagcgaaactcctactagtagtaataataaggaggcagtatcacaaccaagtgaagggaagcacaagcacaagcacaagcacaagagcaagcacaaacacaagaacagtagctccaaagatggctcttccgaagaaaaaagcaaaaagaaattatttagtagcaccaaagaatcatttgtaggaagcaaggaattcaaaagatctcccagtgaacttacccaaaaatctaccaaatcgatacttcccaggtcgaatgctaaaaagcaacaaacatctgcttttaccgaaggtatacgctctatcacagcaaaggaatctatgcaaactgcggactgttcaggctggatgagcaaaaaaggtaccggtgctatggggacttggaaacaacggtttttcacacttcatggaacaaggctttcttattttacgaataccaatgatgagaaggagcgtggcctgatagatataacggcacatagggtcttacctgccagtgatgatgataggctcatttccttatacgctgcgagcttaggaaaaggaaaatactgtttcaaattggtccctccgcaaccggggtccaaaaaggggctaacctttacagaacctcgcgttcactattttgcagttgagaataaatctgaaatgaaggcatggctgtcagccataataaaggccactattgatattgatacaagcgtccctgtcattagttcatatgccacaccaacgatacctctaagcaaggcacagacgctattggaagaagctaggttacaaacccagttaagagatgctgaagaggaagagggaagagatcaatttggatgggatgacacccaaaataaaagaaattctaattatccaatcgaacaagatcaatttgagaccagcgattacctggaaagttcagcatttgaataccctggtggcagactttgagaactgcaatcattagttacttcttgaccaacttaaacaccttaataattaatatttaatagaacataatatagtgatataaagtatataaaaataaaaagtttacgaattaatacaatcaaattagacactgatactatcaagaagtacatcgcaggaaccgcagacatgatgtcctcttctttcaaattactggatatatatattattattattgttaccattaacgttattattattaactattactattacattaacttaaaaataaatatgaaacaacgaagaacaaaaagaattatgaaaacatttaacatgtttcaatttgttatgttttggccaacctgcgtttattcttgcatatgacatttttgtaattcatcgatgataacttggttaccctttggatccaaattcatagcaacagttagctccttgattgcatcttttttcctcccaactattctatatgtttgacccagcaaataatgggctgtggcatcatcaggaacgagtttcaccaattcttcaaaagtttgcaaagcaacattatatcttgtcatggaatagagcaactggcccatcttatatttggatagcgaggaagtcggttgcaaatgacatgctagttcataatattgtagagccttttccttatagcccagcttttctaaagaaccaccgcaacaacagattaacacaacattgacgggattaattgaccttgccttttcaaaatataacaacgcttcttcatattgacctaatttcatagcgctcgtacccaatccgtaatatgcattgtaatgctgaggatcacaagctagcgcctttctatagcatgtcttggcagaatccgaagaatcgttggaagaatgttcatgaccttgcaaagtatacgcgtatgcaaaatttgggtctaactgagtagctttttcgaaggcttttattgcggcatcatgatccttttgcaatgatagcaaattacctatacaacaccatgtttcgggcttattaggcattgtatccattagcccatttgccaaatttgaagatttaaccttgtcatgcaaatgccacagcaaagtagaaaaaatttccatatcttttacccttgccggttgtaggtctttcaatctattgaaatactttaaggacatatcataattaatgatctcaaaatgaagttttcctaattgcactagacaccatggcattgtgtctttaatatgagatgggatttgagactcgaacagtcttattgccttgaacgaattgtattgtgatgacgaccttaatattaaagcgaaattatacatgatttcaggcagcgtaatttgataatcactcgttagtattgagttactgattattaaagaccttggatttttcttggaagttgttaaccttcctgttgaggaatataggtttcttggagttttgaaagttgttttatttataatgttattattattattattattattattattattattattattattattattattattattattattgttattttggtggttcctatcgttatttaacagtttcgatggaggagtcgttaaaagtttgtttctgttataaactttggccaacgagcttattgtaggctgtttggaggatggagacactaagttcatggaaatgttatttggtagcgcagaagacgtcttactgttgattgcagggtttttaggagtttgagtatttttgttctggcaggtccttattgatgtgttcgcttgttgctgctgtgaccttgagaaatgctgaatggaagaaaaagaagatgccgatgtagaagggggagaattagacgactgaaacagtgtattaacattattattgatattattattgccgtttttgtttgtttttgaatataagctaggttgtgaacgaggttcgaaatgcgatagtgatgtagacggaaacgatgaagctgcattattattatgactattactttttttccctgcaatgtcgaaaaaaaccctcttgagatccacggtagctctcattttacaaatcgcttcgtaagattcccaaaggtaaggattaatggctaatgcttcagaatgataaaatgctccctccttagaatggtccagtttcatataaagattgcctaacaggcaattcaaagtggccaaatcgggaatatggacgagattagaattcaacaccatatttatgcgcgtattactgctgttcgaagaaaatacatttattattgagagaagagtgaggatagcttcgttaactccctgcgaaagctgtaaagcacaacgcccgaatatgtaagcgataccaagatgatactccttgaattctttggatatctggaacgcagtgtggtagcttttattcagaaacagcgaaagtgcatataaatataccgcatcggaccagtaaacacttgatttatcgagaatggagcattcagcatagagcagttcggccaaaaactctgcggtactgtagttcaactgctgaatagcctgctgaatgcagtcctgaagctgtatgatggtgctcaaagcttgatcatcaaagctggggattcctctcgagagggtgaacggtgctaactcaggatttaccgccatgctatttttattatgtatcctgcacgaaaagttcgtgtcgatttatgaatagatatgcagtcaccaaaacagagtctaaaactctcacagctaggtatggttttttgataaacttttctgtggcacctttgcttgcactttgatccttttggtttactttcagcctgttccatccttttgatcaaaaaaaaaaaggaaaatcaagcgcgggtaataacggcaccattaaatactagtagtactatatagatggtataaagaaatgatttaaaacaatacgattatatgatatttatacatctgtttcagttgagctttttttccatagagctggtggtacgaagatggcttttggcgagggcgaccgaaccagatagctgcgtcaaggccaatagaagcaacagaacagtattcaatgccaacaatagcgtgcttgcttgtgagtttggtggataggaattccagcaccactcgtgcaagacgtaccaaatgggaccaacgaagaagggcattcccgaccaaaagatcagtataggcaaagtccagtgataccaggatagaaactggtagtggagggaccttgaaaataggacgccgatgaagttggatgcgattagaacgaatggaatagtcttggcgggattggcattgagcactgcatttttcctcagcggatggcacagggaagaccataaatcgggcaggatgcgagggtatcttgtgacgaacagtgtggtgagcgctatcaggtggctgattaaaagggccaagtggaacctcttatcattgaaagcctcttcatccatcatttgccaattgatactccattggtacataaacttcctgccgaaattaaaagcgcaatgcaggtactgttgcggaaagctgcgcaggaagggcactgcaactgcgacttgccatgcaatcatcgcaacgagatccaacaaagtaaggattacgttcgcgtcattaaggatgaatagagaaatcatcattgcagggaaatacaacagcgcattcatcttaatgctcacagccatactgtatgttgcggagatcaccagcgcaagggacttctttaatttggggcgctgatggcacctgctggccacgatagcccccaaaaccgtgacgaccataaacaaagtagtgaagcaatcattgaataaccgtagcacgtaaatagagtgcaatcttttagagaggcacgccaagaccacacaccacggtggtagatgtaaaaggtagtaacacgccatttgtaacgccagtgtaaggagatacaagtatctgaaaaacacttgcccgcgctcaacgtggtccattccctctgttagccagtacatcatcttgtagatcaagacgtggcctgctggatacaccagcgggcccgttccaccactcacctgagagtagtccagcatgccatcgagctgaatcatctcgatctgctccatgtacgccttgtaatcgatctctgtgtaagctaccttcttaatgataatcttgcacagcatgctttcgaacaaaatcaaaaggggcataacgataagattggccctacaatcgaagatcacgtagcgcacaccgtccttgagatcctgccacagatccagcggaggtctgacaaattgcttcctttgcagagacttttcaccttgcggagactgttcaccttccatactactagtatctaactctttctctctcccatacacactctatgatactgttttcactcccaactagtgtactgcgttgttctttaagttcgatagcgaaatttctttagcttgtttacagcacccagcaaccgcacacagaatgtgacggcaaatgcattttacatggaaggctatctacaaaacagcaataaagagtcatgtaagattgggaaatctctaatgtgacattccatacttgttgcaacaattttgggatgcttctgcgtcgtacgaccctgtatttaccttctctagctcatcgcttcccagggtccacgttaatttttcaattttttcttgcgtgtcgaagattcaggtctcgagaaatttgtcaaaaatttttcactagatattaagaactatatacatcgaataagatgccagcacagaagagataggcaatcagtttagatactacagacactatccaatagtgcaaagcaaaagcagcatagaaaaaagagaatcccgtttccagctttttctctttttcccattcgtttttcctgatctttttttctgcatcgtggcacctagaacaagaggtaccttccatccttcgcttaatatttgatacgacttttttgatttccattattattatttgttactattattatttatcatttgggtttcggttttttgtaataattttcttttttttttttggctctatttcactaagacatcgtatatatgccaggccagataatcagcattccgtttttgtcgcagaacgaggacatggataaatacttgttggagtaccgcagtttgaagctccttcatcagtccagtaattccttccagtctcacaatgcgccctcccaccagtcgaactaccacccccattacaatcacatgaaatacaacaacactggtagctattactattacaacaacaacaataacagcagtgtaaacccacataaccaagctggtctacaatccattaacagatctattccatcggccccgtacggggcttacaaccagaacagagctaatgacgtaccatatatgaatacccaaaagaaacaccacagatttagcgctaacaataatttgaaccagcaaaaatacaagcaatatccccagtatacgtccaatccaatggttactgcacatctgaagcaaacgtaccctcaactgtactacaatagcaacgtcaatgctcacaacaacaacaacaacagcaacaacaacaacaacaacaacaacaacagcaacaacaacaacaatctttacaaccagacgcagttctccacgaggtacttcaactcgaactcctctccctcgttgacttcttccacttctaactcatcctctccatacaaccaaagcaccttcgaatacattttgccgtcaacttcggcagcttccacaaatttatcgtcgtcatcatcaaacaactctatgcacaccaacccaaccactgcaacatcgacatccgccgatttaatcaatgatttacccgtgggccccacgtccagttcgcttatctcggatctacattctccaccaactgtatctttcctaccagcaagccaaaccctgctcatgtcctccaccacatctagctctattggcaccaacataaacccaccgcaacattcaccatccccatcgcaaagggaggatttttcgacggcaccagtgaacatgtcttcgtccgcatcactcttgatgaatgattcttctttaggatgggggtctaaccacatgaacgtatcttcatcctctcaaccagcatcatcaagaccctttggcatttggaatactgacatgagcgtttggagttgagatgtttacgtatatttttatgtatattattatcattagtattactattattgttattatttatgcacggttcctatttacacgcggcgtttatattttaccattgaatatttaagatctctttgaattttttctcgaattcgtttgcctttatacgtccctggcttcgtctcattccttgtccaattaggaattttaaagaggacttctttttaccagtaaccaggttccgtataaaagtgtcatctgtgtgctgtgcaatgacatcattacagagatccatcaattcttgagggtcgacctgattaatcgcatgcaattcaaatttctcgattagttttgaaaaatctggaatagacaaatcttggcagttactctgctcgaaattttccaatatgtgaaacagtaacattttaccactagttgcggatataacctcttcatgcaataacttcaaaaactgggcgaaaaccggaggagccaaaatttcttttgctttggccaatggaatttgtagcttgttcaaatctcccaagaattcatggattatccaattcgtaggtaatttcgcgttactacgttcaccagcaagcttggaaaattcacggaaggtgtctaagtagtacgatctcaacgcctcatgattgtacatatcgttttggttactattataagtcagaatcttggcgtccttcaatgataattgatagggtttcttcataagaattctcattatatcgtccggtaattggggcatcaaccctctcacaccactgataacgtctggtgcgaggttgatatacggcaattctggatcaggcatgtacctgtaatcgatcgtggtttctttgcttctcaacttcaccgttgatgagcctgtccagccccttgtttctggctccatcagtgagctagtgtcacccacagaaatcaactcaacttgccgctgatattcgtacttgattgcattgatgatggaactagtattgggtaaattcttcaactcaacgcgtgcatattcattaattgagaggttaacgtccactcgcatggcgcccgtttccaggtccccagaggaaatgtgcaaatgacgtaccaaattctgatattttttaataaacgctctaacctgtttaatatcactgaaatctggtttagttaccaattcgataagcgggacgttcgacctatttaaatcaaccaaagtaataacgtctttatctgtctctgtatagtgtgacttccccgtgtcctgctctatctgcaactgtaagataccgatttccttggctgattcatcgatatcatccaattccttcgacagattgatcttcccaccccgagcaaacggcctgtagtgctgcgtcagttgatagccttgaggttgatctccataaaaataatgcttcctatcaaactgagatatgctattcacttgagaacccagtgccaaggatagtttcatggcaaacaagattgcttccagattcaaaaccggctgcgttcccggtagagctatgtcataataactagtatgatggtttggtgcatccactagagatgtggcgctattcgttgattgtgaaaaaagcttgtttttggtgttcaattgcgtatgaatctccaatccacacttcaatgcatattccggcctgaagggtgcaccgtgactatgtatggctttggttctggccaaagaataaaaacgtgcaagccgcaacatatctagttcctactctggtctttttggacaggaatgctaacaataacactattactaggtggtacgactaagtacatcacgtcaagcttattactactataactactattatcataacaaaagggaaaactaaaccctatctaaacaagggttatttaaatttttaacaagggcatacaacaaaaaaataataaacctaaaatcagaaagttaatctttcagggcttttgaaagtggaattaacgtctctagtaaacgaggattgtttccaatgagattctaagacccaaatatcctcttctttactttgaaatgtttgcaatggaccatgattatggatgtgttctttgtgacacgctttcaatgtactctatatcgtgttgcacgaaggattgttactttatttgtaaaaaaaaaaacaatttttcgagatgggacattaatattgtagaattctgaacatattagtgaacagttctttcggagaattactggaacctaggatctgacaagcgaacaaaaaagcagagtgcgtttattacttctctttctagcggttgttcatgtttcaaagttttttccacaacaatgggcccgctgctgccggtgaaacgttttcagatagcagatcgtaccctttaacgaatcatcaagaagtacccaggaatggactgaatgagttggcctcatctgcaaccaaggcgcaacaacaacctacacacatattaaactcatatccaattaccgggtccaacccactcatgagggcaagcgcaatgggggcgacctctggcagcatcaatcctaatatgtccaacatgaatgagcacattcgtgtttccgggatggggacttctaagcccctggacttagcgggaaagtacattgaccatctacaacataaagatagtaacactcccgtactcgacgaacgatcttattataacagcggggtagattataacttcagcagagaaaaaaacggcttaggagcgtttactccatttgaaaagcaagatgtgttcaacattccggacgagattttgcatgaattttccacttcacagacaaaaactgatatgggtattttcccggagttaaatcgatgttggataactattgataataaactgatactctggaatattaacaatgacaatgagtatcaggtggtagatgatatgaagcataccattcaaaaagtcgccttggtaagacctaagccaaacacctttgtgcctgccgtgaagcatctacttttgataagcacgacaatggagcttttcatgtttgctatttccttagacaaagccaccaacgaactcagtgtattcaatacacatctatcagtccctgtacaaggcattgatgtaatagacattgtgtctcatgaaagatcgggtagaattttcttcgcaggccaagccagtggcctgaatatctgggagttgcactactcaggttccgatgactggttcaatagtaaatgtagtaaggtctgtctgacaaagtctgccctattaagtcttctacctactaacatgttatcgcagattccaggtgttgattttattcaggctttgttcgaagataattctaacggtaatggcggattttctcaagagaccatcacgcaactaactattgaccaacaaagaggaatcatctattcattatcctccaaatccaccattagagcatacgtaataacagaaaaatcactggaaggacccatgtcaattgagcctgcctacatcagtaggatcataggtaccacgacggcaagggcagcaccgattttgggccccaaatacctaaaaattgtcaagataagctctgttgcaccagaagaaaacaacaatttgtttttagttgctttaacagtaggtggtgtgcgtttgtactttaatggttccatgggcagatttaacatcgaagctttgaggttagaatcgatcaagttcccccctagttctgtaactcctgaagtcatccaacaagaattactacatcaacaacaggaacaggcgaagagaagctttcctttcttttcaaatctaatgtcttccgaaccagtcctcttaaaattccaaaagaaatcatctgtattactagagactacaaaagcaagtacaattatttccccaggcatatttttttccgctgtgatcaagtcatctcagcaaactcatcaacaagaaaaaaaagagaactcatctgttactggaacgaccgctaccgcagggtctaaaactgtcaaacaacagccagttactttacaacataagcttttcgttagtgttccagattatggtatcttgaaaacacacggtaagtacgttgaaaatgccacgtttttggaaactgcgggcccagttcaacaaattattcccttatcggggttgtttaatgcaacgacaaagccacaaggatttgctaacgaatttgcgacacagtacacatcagaaactttaagggtagcagttttgacgagcacttctatcgaaatttataaatatcgtactcctgatgaaatttttgaggatctaatcgataatccgctgccattcgtcttaaattatggtgccgcggaagcttgttccactgcattgtttgttacttgcaaatcaaataaatctgaaaaattaagatctaatgccctgacttttttaactatgggtattcctggcgttgttgacatcaaacctgtctacaaccgttattctgtatctacagtatcctctttattgtcaaagcccactttatcaaccgcaacaactaatctccaacaatcaataactggctttagtaaaccctcccctgcaaacaaggaagattttgacttagatgacgtaatattatcccccagattttacggtattgcattattgattaccagactacttcgagatatttgggggagacatgtcttcatgacttttacagataatagggtgacatcccatgctttcatttcttcttctgatccaatcactccatctattaataacctaaaaagtgatgaaatttcacaaaataggaacataatatcaaaggtttctatttccaaggattgtatcgagtactatctatcttcaattaacattttaaatgaatttttcatcacttatggtgattcaatttcccaaatatcagctccctacgtattagcgaacaattctaacggcagggttattgataaaacagaagaagttgcaaaccaagcggaaagtatagcgattaatgcgatgatcaaaatggtacagtccataaaggaaggtctatcattcttgaacgttttatacgaggaaagcgaagtcgaaggattcgacaaccaataccttggtttcaaggatataatcagttttgtaagcttggacgtccaaaaagatttagtcaaactagattttaaagatttatttgctccaaatgacaaaacaaaatcattaattagagaaattttattatccatcatcaataggaatatcaccaaaggtgcgtcgatagagtataccgcaacagctttacaagaacgctgtggatcattctgctctgcaagtgatatattaggatttagagccattgaacatcttagaagggctaaagaaattggcttgcgtaactatgattctctaaactatcacctgaaaaatgctactgctttacttgaacaaattgtggatgatctttctatcgagaaattgaaagaagctgtatcaatgatgctgagtgtaaattattacccaaaatctattgaattcttattgaatattgccaactctatggacaaaggcaaactagcttgtcaatatgtggcaaatggatttttagaaaatgatgataggaaacaatattacgacaaacgtatcttagtttatgacctagtttttgatactttaataaaagtagacgaacttgccgaaaaaaaacagtcatcaaaaactcaaaaccaaatttcgatatcgaatgacgatgaagtgaaactgagacaaaaaagttatgaagccgccctaaaatataacgatagattattccactatcatatgtatgattggcttgtgtctcagaacagagaggaaaaactattagatattgaaactccattcatactcccttatttaatggaaaaggcaggtagttcattgaagatatctaatatactctgggtctattattcaagaagatctaaatttttcgaatctgctgaaattctttaccgtttagctacatcgaattttgacatcacattgtttgaaagaattgagtttctttcacgcgccaatggtttttgcaacagtgtgtcaccattaagccagaaacaaagaattgtacaattagctagtaggatccaagatgcatgtgaagttgctggtattcaaggtgatatattgtcgctcgtgtatacagacgcaagaatagattcagccattaaagatgagctgatcaaaactctagatggtaaaatattgagcacaagtgagctgtttaatgattttgctgtacccttaagttaccatgaaattgccctattcattttcaagatagcagattttagggaccatgaagtaattatggccaagtgggatgagctattccaatctttgaggatggaatttaataataccggaaagaaagaagattcaatgaacttcatcaacttactgtctaatgtactgattaaaattggtaaaaatgttcaggattctgaattcattttccccattttcgaactctttcccattgtctgtaattttttctacgaaacactacctaaggaacatattgtatcagggtcgatagtttctatattcataacagcgggtgtttctttcaacaaaatgtactatattttaaaagaactaatcgagacatcagattccgataattccgtatttaataaagaaatgacctggttaattcacgaatggtacaaatcggacaggaaatttagggacattatttcctacaacgatatcattcacttgaaggaatacaaaattgataatgatccaattgaaaagtacgttaagaacagcggcaataatttggggatttgtttctacaaagaataaaaattcatgttcgacatatagatagcagggtaatgtacgtgtatattttaatgtaataaagaggccttactagacggtaaagttaagaatatcgagtgaacttttccttaagataaaggtaaatatagtcgagtatttatttattattcttttccactatacagtatttaaaattctgtaagaaattgattctacatacataagacaaacgaacaggtcagagagaatcagatttttggttagcaagaatacattttggagaagaaagacattaactccaccttactgtatcatcttatttgctttttcactccttcctaatattttttttattttattttgaatttcttcctatttctgatgcattgaacagatcgtaatctgtaagtaaataccataacgtgctcacatttgtctccaaatactggtgaaatcttggctccgttgtgtacaaaacttcttaatgaatatatatatatttttcccttattttatctttttttttcgaattttttatgtaaacattcttatactggaacaatagatggctaatgagtccctataatttcgattttagatgttaacgcttcatttcttttcatataaaagactacctgccaaatgtattttctcctgagtaagtgacatacaaaaacccgtccttatccttgtgttcttgatatatggcagacatcaacgccgcagtaggtggcaaagtatcattgacaaaaatgaagatggccttctcagggggtagcataattctctttcttataacataaacaaattgccctacggtaaggtcagcaggaactagatatttacgcttatcaatctctggaatatctgacttttcagctttttcgcaaatcacaggtatcctattcttgaacctgtcagcaatcctctccgactccgccttccttttttcaaatggatattcagacttaaatgtagacttcatgtctctagtaattatttttattatgattttctcaactttacaattattagattctcttatcaatcccctcctcaacctttaatggttcccctttttgtatttccataattataccaaatatttttgccgccgccgaaaataaccggcctccgggtgatgatatatcatgtgctatgatttcacgggtattatacaacattatcggtggagacagttagcattacatgactctaacttaaacgtaaacttacacatatacatctatatcacttcgagtagagaaaaatttgtacgtatttatatgagttgttttcataatttgaacacttttaatttgaaaatggtgtcattaatagattgttcttcatcaccaattgggtctgtctttgagccgtcatatttggcaatgtcggatctacaggtcttgcttaacatatcaaaatgttctttgacaatggcttcaaagtcgatagtatctttaactaattcgtactccactaaaacatcgtcggtggcttccaaaccacacttctttctcaatttttggattctgttgaccagctctcttgcgagaccttcactctttagttcagagtaaatatttgtatccatgatgattaacacgtcttggtcggttctggtttcttgtccagcttggacagcagattctggcaagcctctaatagcattcaaatctcctttaaccagttcaataccggcaacctccaactttccgctttccaaatattcccgtacttgctcagaagtgactgatggtagggcatctttaaccttctttgcgtcttttttcaacttcttacccaatacaggccaatcagcaactgctttatactcaacaccatattttgcctcatcggaggtgataacaacatcacgaacatttaattcctcgataatgtagtttttcaaggcttctacatccttcaagtatgattcatcactgtgaaggatgaccaaagtcttcaatggagtttttaaggaaatagttttcttttcacgaatgtttctacccaaatcgataacggattgcattctagaaactgcagtttcgatggcctcgtcaaagtattctttcttgaccactgggtaagataagaaatggactgatcttccgtccttaccgtattttgctaagacagcttctgggatgtattccttcagtctcaaataaatgctttctgacaaaaatggggtgaatggagccatggcacggacaaatgtgaataaggcatcgaataaagaatttaatgctttcaaacagtcctcaacaccgttttcacccttcaaacgacgacgattaaatctaatataccagtttgtcaattcatcaatgaaattcaaaagttttggaacgacagtgtataatttgtactgacccatttcttcgtgaatgaattgtactagagattgcatagaagctaaaatccatctgtccatgacattatcacttttcacagaatcatcatattggaagtcgatgttagacatctttttcaacaaggcaatttgaccgtccaaaaatttaaaggagttccaccatggtagtaagacctttgaaacaacctccttaacaccctcttctttgaatttcaaactttcagcttttaaaacaggtgagtttatcaagtacaatcttaatgcatccgcaccatatttgttcagaacaatggatggatcagggtaatttttcaaggatttagacatctttctaccatcggcagctaagacaataccagagacgatgacgttcttgtatggaacagagccaaatagatgggtacctaagacagctaacgtgtagaaccaacctcttgtttgatccaaaccttcagagatgaaattagctggaactctttcgtcaaatttttctgtgttttcaaatggataatgttgagaagcataaggcatagaaccagattcaaaccaacaatcaaaaacttcttcaattctctttaagtcacccttaccttgcttggatggaattgtcaatttgtcaatgacatcacgatgcaagtcagtgatgttacgcacaccggtcaattcttccaattctttgatagaaccaacacagacgacctcctcaaaatcgtctgaaacccataaaggaattggagtaccccaatatctatttctggaaacgttccagtcacgggcattggcgatccagttggcgaacctcttttccttgatggtgttaggaacccagtgagatttcatcacagaatccaacatttgagggacaatgtttttaacacgaacgaaccaagctggaacagaacggtataacaatggggtatcggatctccaacagaatggataggaatggcgaatttgggatgccaataacaaatttccagtattagttaagtacttaataatcaacttatcagcgtccttgacataaacaccctcaaaatcaggaacgtctttcgtgaatctaccaaggtcatcaatggcgttaggtaacactgaatcttcggatatgacgccgttcttcaaacaagcagcattatcctcttcaccgaaagcgggagcgttatgaacaataccagtaccggaatcactagtaacataatcatctgaaataactctaaaagctgtttcatggaactgttcagcgaaatatgggaacaatggttcatacttcaaaccaaccaaatcagaacctttaattttttccacaatcttatatttttcattcttaggcttcttatacaaggttttaatcaaagattctaataagatgaaataacgatctctggtttcgtcgtaaatctttacatattcgaaatcagcgttaacacataacgacaaattggaaggtaaagtccatggagtcgtagtccatgcgaccaattgagttttttcctggccaataacattgaaaccaatggtcacagctgggtcgttaacatctttatagttttgctgagcttcaaagttactcaagggagtggttaggccagtagaataaggcataactttgaatccacggtaaacttgacctttttcatgaagttgcttgaaagcccaccatgtggactccataaaggatggatacatagtcttgtaatcgttgtcgaaatcaatccaacgacccaaacgaccaatagtttttctccaatcactggcataagtcataacaatggatctacactcattgttgtagttttcaagaccatacttgaagacgtcatctttacccgtgatacctaatttcttgtcaatgatatgttcaattggaacaccgtgtgtatcccaaccgaatcttctttccacgtggtggcctgtcatggtagcgtatcttggaacaatatccttaatagtggaagcaagaatatgaccgtaatgaggagtaccggtggcaaatggaggcccatcgaagaaggaaaactccggtttgtcttttgttaattctaatgaagtatgaaaggcatctatttcatcccaaagagatagaactttttcttcctcctttggaaatgagaagtgtgcgttactctcggacatatttccttggttttttgaagcttttggctaaaggttgtaggaagtcgagtaacatcactctagtttaaagcgcaaaatgatatttttcatgcttaagagtcatcattgtttcgagatttcttgcgtgctgcggaaacaaaaaaaaaaaaaatttttcgtcatcatggatagattacccgccatcgtataaaaggttaaacataaaaagtagctaaatagaacactatagaagaataatcaatcaacctcttccactgttggacctgtatcttctccacctcccgtagcacccgagttgggcatggatccggggaatccaccggattcccccgctccaggacctgcgccggcaccagcaccgtaaaatttcgtcattattggattggcaatgccttccaactccttttgtctatccttatattcgtccgtagaggctgcctgcgatgcatctaaccagtcaatggtttcctgagacgctgtttctaatctctttgcatcatcttcacctactttctctttgaaacttgcttcgtttatggtattcttcaaagtaaatgcatacgattcaagctgattcttagcctgaactcgttctgcctccctttcatcgtcagccctatatttttcagcttcagaaaccatcctatcaatatcatccttcgagagcctacctttatcgttagtgatcgtgattttgttactcttaccagtacccttttccaaagcagacacattaagaataccattagcgtcgatatcaaaggtaacatcaatttgaggcacacctctgggagcaggcggaatgccacttaattcgaatttaccaagtaagttattatcctttgttcttgttctttcaccttcaaagacttgaattaaaacaccaggttgattatctgcataggtagagaaggtttccgatttctttgttggaatcgttgagtttctaggaattagcttagtcattatgccgcctgcagtttcaattcctagggacaatggcgcaacatccaataatagtaaatcttgtgtctttgttgattgatcgccggttaaaatggcagcttgaacggctgcaccataagcaacagcctcatccgggttgatagaacgattaggctctttgccattgaagaagtcagaaactaatttctgaatctttgggattctggtagatccaccgactaacacaatctcatcaatttgggacttgtccagcttcgaatctttaagaaccttttctactggttccaatgtggatctgaataaatcagcacatagctcttcaaaccttgcccttgttaacgaagtgtagaaatccataccttcaaataaagaatcgatctcgatcgaggtttgagatgaggaagaaagcgctctcttagctctttctgccgcagttctcaatcttcttaacgatctttgattattagagatgtcctttttcgttttccttttgaattcagtggctaaatggttcaccaacctattatcaaaatcttcaccacctaaatgagtgtctcctgcggtagccttaacctcaaaaacaccctcatcaattgaaagtaaagagacgtcaaaagtaccaccacccaaatcaaaaatcaggacattgtgctcagccctgcctttcttatccaagccataagcaattgctgctgcagtgggttcattgataatacgtaaaacgttcatccctgcaatagttcctgcatccttagtggcttgtctttgagaatcattgaaatatgcaggaacagttacaacagcatcattgaccgtagttcccaaatagttctcagcagtttccttcattttgcttaaaaccatggaagaaatttcctcaggcgtaaatgttttcgtttcacccttatattctacttgcactacaggtttaccatctctggatataactttgaaagggaagtgcttggcatctgtcgtcacttcaggatcatcaaatttacgaccaattaaccgctttgcatcaaaaactgtattatgaggattgattgcagcttgatttttggcggcgtcaccaattaatctttcggtgtctgtgaaagccacatacgatggagtggtcctattaccttgatcatttgcaattatctctaccctatcattggaaaaatgagcaacacacgagtaagttgttcccaaatcaataccaactgctctagacatttttctttgtagcgtttagtacctattctatccgtttagtgacaaacattgacatacaagaatgtttatgctaccaatttcagtcactttatatacccttccattcgtttccaattgtgcaatatgatacatcccttaaccatcttctggtcacccttgtggctgcttctgtaatattctataactttccacagcgatccctaattaagggcacccataacctccataggcatcaagtcaaatacgtttgatgatagcgccgcacgatgatcgttatggcctttggtaatagagaccgccaacaatggtagggttgtgctcatcatcctcgtcatccctttcttcatcactgataccgtaaataagagcgtcgtcttcattgtctttaccaagcaattctggatatttgttttccattatcttttctgtgttgtgtagggagtttttttgaaatgacgaatacagacaaatattccaaactcgttcattcaacaagatgtctgagtattgttcaggcaatgtctttatctgataatataagatttcgtctaatttatcgagcatatgtttaggcaccgtagcgcttgaacatatcagttcgatcatagcatgccattgcaaactcgacccgtagttaccaaaaaacatggcatttaagaacgcaaactgcaactccccaaaataattacttgaatttttaaaaattccttgtagcattacagtgttcaagtagtaagacttgtctaaaaaatcctccatttcatggccaggccttatggcttctctagatttgaagtttattactgtatagtttaaagaatgtgcaggatcatcttcattcttggcttccattttagaacctgctttttgcaagctggattttagcagctcattttcttgaactgtggtcatcgaagaatctacgtaagagaactggttttcatctttccttactatctttcggattttatccatctgcacaaactcggtaagattgtaccaggtatcatcttcgtcaattttcggataagaaaccatcatctgccgttccttgaagttgtgaacaatattctcgaattttgcgccatccctttcttccatcattttgtaaaggccatctttaggatcatactgaatgtaaaagtttcccattctacagtcaaaccagtagccatacctcatgctggaattatctgcatgctgaaaatgaatgacatgaacgtgtccaatggggatgtccttgattccgtgaaatggctgattctccttgacattaaaggaatactgatcgatccctatagttacctcaatcggagcagatgtaaatggtacagtattcattgcaggcttccgatattttattttttagccccatgtcccagcgataaggaggatctttggtgtccattcatctcattaaaccctaaaccattgaaatattcgtgttcgtgcgtcgcgattttttccgctttcaagatgtgtcctttcttcatctcttggttcttataaaagggcgccgcaaacccctcctaattactttttccttttcacatcccatgggttttatcttataccaaatgtttaccattctgaatcgtatagccaacaagtaaccacagctgcaattgtgaaaaaaattgataggtgtggtcacccaactgtttttttctctttttctttttttttttttgaaatggctagacggtgcttttgctggtaaaagaaaaactcttgtttcaatttaacatgatgaaaaaatatattaacacagacctgtactgaacttttcgaagttttgcagataacaatattgctttttttctctgactttaactaatcgttcttatttctgtatatactatgaccttgcaaaccttgaaatgcaaaattcgtattctctgctaaattgaaaaatttagagcatgaagtgtgttttccagcagacaccgcctgtgaaaaagatggtaaaatgatatgataattaaacacacataataatagcatatatgatatataagactatatgaagagatgaggagaagagaagaaaaaattggtagtattttcatttcatctatttcttagcagtcaatcttcttaggtagaaagctaattcttcaccttccaagatgtaaccatcacatctaccggattgacctggtctggaagagatacaagcgtataatctaccggcgctgaattgagattcaacggaagattcgatcttggcagaagcagctctagcagcccactttctttcagcgttcttgctcttggcaacagtttcttcttccttgacgttcttcttcttacccaaggtttgaccgtagtgagcttcgaaccattgtctgaatggagtagcatcaatttggacaatggcagccttggtcaaagtgttagttctaaccaattcattgttggatggatggtaaacaacaccagcaattctggtcttcttggagataccttcagaagcccaagaaaagttaccggtttcaattcttagagctctgtatttcttgttaccacctctagttctaacagagtgaattctcttagcaccgatcttggtgttggctggttgacggcctaattcgaactttctcttctttctgaattgagcacgcttggcaccggtagcggatcttttgtgacgagaatcacgagaaatacccattttgtaactgtaatagaaaatttaatgacgcttgttagtaaaataaagaacgtacaaaagttgcggaatttttttcttatcttgaaatatgctttggtttcttttcatctcttcttgtgaaaaactcggcgtttcataagaggcttgatttttggggtacacaaaggattcagtttagtgcactgctcctgtcacaatttatatcatcccttttagttaagtttactttttccactatctattccattcaaagagaggtcctgtagcattcaaaataatatgtagttccattactcatatgaccatagcacatactttttgtcctggtgtgtttataacgtcttcttgtgagtaccaaaaagcaaatggcaagtgtaatttcctataactttaagataggcctgtaaataacgtatatgaaacagttccatcccgtaacaccatgaacactgcgtaagagaaagccctcaagctttcccagcgatgctcgtgtgtaggaccgaacatggaggggggaactaggcccagcacgggtttggcgaggccgctctgctcgcagctcaggattctaaaaggttattccgctgagaaaatcagaaaataggaacttctcacgcaataattttaaagttgatgaaaaaggaaaatttgtaaaagtgtaagggtgttaaagagggtgtatggatgtaaagtcacaaaagttagagcagatgaaaaagaaatgggtggagacaaatccgaaaaaggacctatattatcgctataaagagcttctcatcgcttttttttttcaaagacacatacataccacgactgtaagcacatcatttgtacaatacattaccagctgaaatgtcaacatatgacgaaatcgaaatcgaagatatgacgtttgagcctgaaaatcaaatgttcacctatccttgtccctgtggagataggtttcaaatatatctggatgacatgtttgagggcgaaaaagttgctgtttgtcccagctgctcactgatgatcgatgtagttttcgataaagaagacttggctgagtactacgaagaggcaggcatccacccccctgagcctattgccgctgctgcctaaagatgagaggctagatcgagaatacaaatagaaataaagaaagagctatatgacttagcaacgcaagcagaaaagaaggtttgcttcttcgctggactccggttggaattactattcaaaattccaagtgcactgatggaaaacgttttgctcaggttgagctcttttactgcatataaggatactgggtaggtgtatatgattattttatacatgatacgtaggctaaaatgatttggacccattaaatcatcttgtcgcatctcttttctttttcctccatgctcagatttcaataatatcatctcaaatggctgtgacaaatttcaccggaaaggcgagggatttttctgttgacattatcaaattagctttttgtcaaaataatgaaaaataaagaaaatatataaaagtacatattataatcaaagctagctcaggtatattcccaccttgtcgagcattccggaagctacaaatacgacattgcataccaagaggcaaacgttgaacaatggctaaagatattttgaagaaccaggaccctaaattgcaagcgatgatcgttgaacactcggcgcctgctcccaaagagatacctatggacgctcctgttttgaaaagagtcgctagacctttaagacatgtaaagttcattccaattaaatcgctgatattccatactaaaacagggcccatggatttttcttatgaaaagaagatcaagacgcctattcctaagaacaaaattgtagttcgagtaagtaatgtgggtttgaaccctgtagatatgaaaatcaggaacggctacacatcgtcgatttacggtgagatcggcttggggagagagtacagtggtgttatcactgaggtaggcgagaacctaaactacgcctggcacgtgggtgatgaagtatacggtatatactaccaccctcatttggccgtgggatgtttgcaaagttcaatcttagtagatccaaaggtggacccaatccttttgagaccagaatcggttagcgccgaagaagctgcaggctccttattctgcctggccaccggctataatattctgaataaattatccaagaacaagtatttgaagcaagattcaaacgttttgattaatggtggaacttcgtcagtggggatgtttgtcatacaattattgaagcgtcattacaagttacagaaaaaactagtgattgtaacgtctgcaaatgggccccaagttttacaggagaaatttcctgatctggctgatgaaatgattttcatcgattacttaacgtgtaggggtaaatctagtaaaccactaagaaaaatgctcgaagaaaagaaaatttctcagtatgatccggtcgaggataaggaaactatacttaactataatgaggggaagttcgatgttgtactcgattttgtcggtggttacgatattttgagtcattctagttcattgattcacggcggtggtgcgtacgtaacccactgtaggtgattacgttgccaattataaagaagacattttcgattcatgggataacccaagtgccaatgcaagaaaaatgttcgggtctattatctggtcatataactacacacattactattttgatccgaatgcaaagacggcttccgccaataatgattggattgagcaatgtggcgactttttgaagaacggtactgtaaaatgtgtcgtcgacaaagtttatgactggaaagaccataaagaagcattttcttatatggccactcaacgtgcccaaggaaagttaatcatgaacgtcgaaaaattctagatacccacttacatttacaatatgttttatttttaaacttaatgaacttcataatttaatgcttaatattttccccctcccaccttctcctggcgttctctgtacgtacataaccatttattttaatatataatcaaatattgtaacaattgaagcagatgagtctcgctccttagttaagcacgtgccgatgatatcaattggatttgttagcaaatcagccttgctgctcgattctctgctttttttttacttctcggtcattgaaaaatcctgacgaaaatatttcaaggtcctatatggtcatcgaccttgagcatgtggtagactacataatgcacatagactctcagcttcaactccacaaggcttctccagcaaaaatgaattcagagtctcgagaagatatggctataaatagtatcaaattgctagcgggaaactcccatcctgatttggctgaacaaatatcgaaaaagttaggtattccactttccaaagttggtgtgtaccagtattctaataaagaaacctctgtcaccataggtgagagccttcgcgacgaagatgtgtatattatccaaactggaataggtgaacaagaaattaatgatttcttgatggaattattaattttaattcatgcttgccaaattgcatctgcaagaaagatcactactgtaatacccaattttccatatgcaagacaagacaagaaagataaatcccgggcgcccattaccgcaaagttggttgccaatttattgcaaactgctggtgctgatcatgtcatcacaatggatctccatgcctcccaaattcaagggtttttccatatcccggttgacaacctatatgcagaaccaagtgttttaaattatattagagcccggaaaacagatttcgacaatgctattttggtgtcgcctgatgcaggtggtgctaagagagtagctgctttggctgacaagttagatttaaattttgctttgattcacaaagagaggcaaaaagctaacgaggtttcaaaaatggtgcttgttggtgatgttaccaataaatcatgtttattagttgatgatatggcggatacttgtggtacgttggtaaaagcttgtgatacgttgatggagcatggtgccaaagaagttatagctattgttacacacggtattttctccggttcagcaagagaaaagctaagaaatagtagattgtctagaattgtttgcacaaataccgttccggtagatttggatttacctattgctgaccagatcgatattagtcccacgttcgctgaagctataagaagactacacaatggtgaatccgtgtcatatttgttcacccatgctccagtataggacaattttttattcttagattcctgattgcttgcatgcctaaatacttcataattgtattagtttaaaagaaaaccttttactgagacaaaactataaatttaagaaaaaggttccggagccggtttaaaaaaagaagattaaagatattatatttatgtaagaattaaattaatactgtcagagaaaaaatagttttaaaggagacggtgaacctttaccttcccttgatatgcaaatatttttcagcttttcctaaaactaaacattctcgacttttttttagaagactttatgggtgtgttagaaacaaagctgtcgtctatagcagtatccaaatcgtctgctataggcagctcttcctttttcttttgaccactattgcaagttcttagccaatcatcgtacttgattagattgtctatattatcatcttgttcttttgccatattttcacgatcattcttttcaacagcgtttgaatacatcgctttataaaacaaacatatgctgttgccatatttggagattcacctgtgaattctaacactgtttcctctttaactgcctctaccgtttcgtcatcaaataacaaccagccaaacttttcatgtttacatagggaaacataatggccgtgttgtgggccaccgcccatatgaacgacaatcccagccaattcatacttttgacaaaccttagaatttattgaagagcaaacatttagcgtcagaggatagtgaatgttattaaaaagcttaatattacagttttgtttctcagaatacttgaatcttttcaagtgtaatgttaaagtatcaggcaattgcttcaaaccaactaatctctctgcctcctgtaaaccgcaacattcgtcacaataaaacttgtttgagccatttagcatttctcgctggtgataacttttcaaaatttcctgtatatctgtttcctcatctccctgaacttctatggggaaatccaaaaatggctcatccctagatgtaatgttatcgcacgtcagacattttatttgattcgttaaagtgccttgaaacaagtcactgatgaaatttttactcttactcggttcgctatcgctgttgatatcactggctgctatttttttattctcacgttctatatattcactcaactcgtttaataagaaattgaaaaattcgtgagcatcctgatgcatagtagtattaaataatacattttctcttttgagaacatcaacaaaagagctaggcgatacaacaccagttaaatacgtattctcagttatgcattcaaagatatctctcaaactggaatacaaagtagccttatctgagccgtttaagctatggtcaatattgagcactggcccacgaataagtgcggatttctttctatgttctggggatatttgagaagaggaactagatcttctagtatcttttttatcaagtggagtggataagctgctattactttctcctttcaagtccaggttattactattactgctacctcttgaaggattttcataattgagaactctgccaacaattattttacgcggaacatccggaggtctatctgtgacgttctcgaaactcaatctgctcggagcaccaggctcattaggtgtttcgactatcaatggaggtgcgtcttgaggacgagaagagggttttccagtggttaatatagcaggacttccttcctttttattattgtcttgtacatgtttcgcgctaaaacttttaaaaaatttactcttcttctctgaaggcccagctgtatttgaatttacagaatttacaggggtaggctttccatcatcaacagattgaggtttagggttaggcaaatgtccattggtaccagcaatgcttttctcaaaacttgcttcggtaaatattcttggtttcttacctctcatttctttctttcttgggtgatcagattctcttgatttttttggaaattgcaatatattttcacgtaatgaggacagattatagagacattgaagaactgagttacagtaacatgtattgccaaaattttcgtatccaaaaactttgttggagccgtctccatagggcattgagtcggacaccttcatagctaatatgggtgcctcgggcccttgcgtgataatgcctccgtatgcgtttatagcctttgcgtttgaaatataaaatatcccatcctggctgtaattactgccttgattgcacgtttcagaagaatagtctagtccggaagaaatctgcaaattattgtcttcattcaaaaaagtttccttggtatccaaattagagacaaacaatgagctagagggattatcggatgattcgctataacagagttcatcatttatatcgtggtttacaggcttaaagtcaaccttttctacttcttctgtaatggtatcattaacagcctttttcttcttcccagacttacttatagttagccatcttctgatcatgattgcgcccttcttgcgtgggtttagtatgttaatgaaagtactggatccttactaaagccgaatttggccccttcaacaaataaagcttgatgagttgaacagtcaaagggtaagatctggtataggcaataataatattatccaaatggaaaaaaaaaaaatgaacaggtgaaaaaaaatcaatttgaaaaccaaagaaaaactctattgattcctttgctgttgtcgaccttctttcacacaatagttcaattacgttctttgggttctttatctttatagttatcttgcctcatctctatgttcaacactttcggatcgatgtatttttcagccttccgctaaaattgacgaccgtctccaaacgaatagggataaagaagcaaggactgagcgttggagaaaaaaaaaaagttaccggaatgggaatagatagatacctataagaagcgttatcgttactcatgaattttggtaaatgcacacggataaatgcatgatatataaaatattaataagaataaaataaataggtagtgaataaatattctactttggtgtggtcatcattttacaaaggagggaggtcgtgataacaaactgataaataatccttaagttgatccattcttgaatattgttacattggaaataatccgaaaaagaatatgtataaataaaaggactcgaagtcctatgtagccgtctttgcaaattttctttaataaattagcagaaaacaagggtaataatatttcttagaatattagaagaatataggcgttaaaaaccttgttccatgttcatatcgaaccaaccaaaaaagtcatcattactggagttgccttcaatccagcctgcactttgttgctgaaaaaaatccgttagtttgtttccaggagtcttcacgttgttttcattatcgtggttggatagagaacagtgttagtcccgtagaatcgtggtcgttgttctatgatatcaactttggaacaactcagaggtggatatcccgtcttttagaggaccggggtcggacgcggaatccaactgtcatatattgaccgaaacaaaggtgtacgtgaatgggacatactactttgtgatcttccaatcgcgttggcgttgctgaattgattattataattcatggtgacattttgtaaattactgtgctcccttggaatagggtggtctattcccaatgtaacattattagataagttgccaacggggtggttccttaaccctggaacggacgcaggaaaatgattaacgggagtgcttactgatcttttcatggagagatcaggaattacactaggtccgttactataatagtctaccttagtactttgtggattgttattcgaagcggggacagaagccactggataaattgaattagagggaattgatatgtcattagacgcatccaataacgtcctattattattataatcgttactattcgaggtattagcgaataaactttgaaattttacgctgcctgtttccccgagcatggaaagaggtatcccgttaatctccattatagaaccgtcagaatctccgttatttgtcttggctagcttttcttgctgctttaaggcattcttagtaggaactaaagtggtaacagtggttccacttggtgttgtttttgttacagtttcaaagtcatctctggagatatggttatatagtggcaatggatatagttttctgtccgttatgccacccgtagacgaagtgccattgtagataccatttgaggaaaattttcttttcttagcggctttctctaaggcttgcttgttatattcgggatccatttcccttcttctcgcctcgtgaacacaccaaaccaaatcatagaatagagaccctgttaaatgtgatctcatcctagaaataataccgtcttcttccacaaaaacttctggatgcatgatcagtacgaagttcagtttttctaacatacttgcagttctcgaaatatcattctcaacactagtggcccacgcagttaactgatttctataaagtctatggatagtgaccacggattgccttgctgaatcaaaatatttgtcaggaagtaaaggagtcaactgcaatttaaagagaatcagtgcagaaaatgtagcagcttgtctaatataaataggcagttcaattaattggtgtgtttctaaaagattattcaatagagtgacaattttagtagctgttagataggcctctgtgacatatggaatttgatcggtaggaggtgtttcgggtaggaatgcaaaacaacagacagttaatttaacataaagaaaataaatgttgacagtatcgtcactctggaaatttaaagtttttgctaataaatctaactcttttcccaagatggacagtgtctcagcacgatactttggttccaataaaccatcaggactggaagtggaagaaccaatgatatgagacaattttgcttggaaattcgccaggctgagcaatcttctaaaactgcccggtagtttgtatttactttcaacgtgcggctcgtctttcttgttccttttatcattgttgttattgtcaatactgtcattgttatcttcttctgattcttcgtcaccacaggataaggctttttctaataaatagtctgtctgtgaagttggtggcaaaccaaggatactcgcccaacaaagttcggcaaaaaatattcccagccaagtcctagttctccacttttctgcatttggcattgatgtttgagttcttgtgaattcagaaatgaattcacctctgtgcaaacctaattgataagacagtgactttgctaatcctacaaaacggtaagaacaatcatctaggactttttggttaggcaaaggccaaatgcacaatattaacaaagcttgcgaaatatgtgtggatctaggtgttcttatccagcaggtctctatggcaagttgcttgatcaaagagcttagcttgcaatacatcgtcggttcaggatcagacagacatgccgtcaacatcacggtccagaaaagcaactgagattgggagtataattcggtggcgttattggaatacataataggaaaatacggcagatacctagtcacgaaaatatggtgtaatctattcgctttttcaatggaaatactaatatcgcccagtacaaactcatctacatttgcatgcggcgaaggcaataatggcatagtcgtggtggtggctactaccggcgtcttcgtcctatctgcattgttatttgttgctacgtggcttgttgctgcaaatggtggttgatttgttgtcgttgtaacggtggtcgacgtagtatgaggggaatatgttttttgaattggagagaaggggccgttcggagtgttacctgcagagttgttcttataaaaagccatttgcaaagcaggaggtaaagattcttttgaattattaggcaatgctgagtcatttagcagcgggggcagcttatttggctctgttgcaaccaagcctttcgaatcttgcgctaaagaagatgcgcgcaacgtcatgtgagaagatgcttcattatttgctttaaatttattcgtattgctgccctgatttgcttgtaagagttggggttccctggacaaataagtttgaactgaaaccttagaatctcgttgagccgcggaagaagttggagaacctgaggaaggagaagaatctgggttagggataatagtacccggagttggagttggatgcagattgagcttattcaaaaggctattgcccatgggaatctgttgtaaaagatgaacgaaaacgctgtcattggccagaagagtatcgagtttagatttgatttcatccacatcttgtctcagtagttgcaactgtgagcccttcttaggcctgaattgaggattgatttcacagtggagaccaattttttcgcatctggagcaaggatgagggaaattttgactagcatcgcatttgattttgtgctgtctacaatgtgtacatgaggtaactggtctatggttgatttgatgactgtcatcatggtgagatattcgttgtttcttacttgggaactggtgctgttgcaactgttgctgctccggttgtcttttcatgtgagcagaactaaaatcttggtcttggtcagaatctcgattatccttcaccatgacgagaatgcgtatacgcagagccaatataatctgtatacgggacctttgacattaaggtttctgcagagagtttattacatgcattttcatatatatatttttaacgccattcctttacggtatgtaaagaaaaatgatccaatgagcggcccttcgtacgagatgagatataataagaatgaaagatagataaaagttttagttagagatacttcatatacctgtatatagtaaagtcgtttatttcaaagcttatttcgacttggtgaatcttaaatagggtttaatttcattaaattgaccaaatttagccttcgcctcatcattggagacagagggaggaataatgacatcgtcagctggctgccaattaattggagttactacgccctccttgtcagtcaattgcaaggcgtcgattacccttaacacttcagaagtgtttcttccgacggtggaagggtaggtaaaaatcagtctaatcttcttcttgggatcgatgacgaaaacagacctcacggtcttcagtgacccatcattgatatttttgaatccttcggcatctaccatatcatataggaatgccacgtttctaaaagtgtcaccaattattgggaaaccaacatttttaacctttgctatttccttgatgtcttgaatccatttttcgtgggactcaacatcttccactgaaagcccgatcaatttaacatttctcttgtcgaattccggcttcaatttggcgaatgcgctgacttcggtggtgcagacaggggtgaaatctgctgggtgagaaaacaagaccccccaagagtcgcccaagtagtcgtaaaaattgattttaccaaccgttgtgtcagcatcaaagttaggagcatcagagtttattcttagtcttggttgatcactttgtttgaattgtttgcacagaataggtgctgtggcaaatgttttaatcgtctgtgattgcaagtgagcctgcttaggaagggtccatgccgtcctctttaattgagcgctacaaattctactaaacatcctttgcttcctgcttctttgaaatttatctcatcctactgcgagaatctagaagcacaattttctatatctctccttctctctttatataccaatagcagcaacatccggccccttgtttctttacgtaattaaaaatctccggggctagcttttgccggggaacccatcccgaaaaaattgcaaaaaaaaaaatagccgccgaccgttggtcgctattcacggaatgatagaaaaatagccgcgctgctcgtcctgggtgaccttttgtatattgtataaagataaacatagtgctatcaggaatatctttatatacacacgcatactgaatgtggttgaagttcaaaaaatatcacaaacgttaagaagttttactggtaaacatatagacatagtggagcgcttgctcgaggtcaaatgcagacggatacgagagcgcgggagggaaaccggagaaggtcaatatgcccataattcttcttctttgaggttggcaattatatattgtatctgaattaggcaaatagaaaagagaccttaccattagcgccatcgtagagtcccatttcaccttttcttagttctttatatatgtctgcgtatggcccacatatgcgcgcacagtgcgcgccaccctctaagaacgataaacataaaataaacacataaacaatcaacgacagttcgcgcttccctcactaaatatggcgagatagttaaacaatcatggctcgttcttccttgcccaaccgccgcaccgcccagttcgaagcgaacaagaggaggaccattgcacatgctccatctccaagtctttcaaatgggatgcacactctaacgccgcccacctgtaacaatggtgctgccacttcagactccaatatacatgtatatgtaaggtgcagatcgcgtaataagcgagaaatagaggaaaaaagtagtgtagttatatctacactaggcccacaagggaaagaaatcattctgtccaacggttctcaccaatcgtattcgtcctcgaagaaaacttaccaatttgatcaggtgttcggcgcagaatctgaccaggaaacagtgtttaatgccactgcaaaaaactacattaaggaaatgttgcacgggtacaattgtacaatatttgcatacggtcaaacgggaacaggtaaaacctacactatgtctggcgatataaatattctcggtgatgtgcaatctaccgataatctattattaggagagcatgcaggtatcataccacgggttctggtcgatttgtttaaagaattgagctccttaaataaagagtactccgtaaaaatatcctttttagagttgtacaatgaaaatttgaaagatctgctctctgatagtgaggacgatgatcctgcagtcaacgatcccaagaggcagattcgtatttttgacaataacaacaataattcatccatcatggtcaaggggatgcaggaaatctttattaactctgcacacgaaggcttgaatttgctaatgcagggttcgttaaaaaggaaagtggccgctactaaatgcaacgatctttcatcaaggtctcacaccgtctttacaatcacaacaaacatagttgagcaagatagcaaagaccatggacaaaacaaaaattttgttaaaattggcaaattgaatttggtggatttggcaggcagtgaaaacatcaacagatcgggtgcggagaataaaagggctcaagaagctggcctaataaacaaatcgctgctaacactaggccgtgttatcaacgcactcgttgatcattctaaccatataccttacagagaatctaagctaacaagattgctacaagactctttaggtggtatgacgaaaacatgcattatcgcaactatatcacctgcgaaaatatccatggaagagactgcaagtacgctagaatatgcaacgagagccaaatcaattaagaatactccacaagtaaatcagtctttatcgaaggatacatgtctcaaagactacattcaagagattgaaaaattaagaaatgatttgaaaaattcaagaaacaaacaaggtatatttataactcaagatcagttggacctttacgagagcaattctatcttgattgatgagcaaaatctaaaaatacataacctgcgagaacaaattaaaaaattcaaagaaaactacctgaaccaattagatatcaataatcttttacagtctgaaaaggaaaaactaattgccataatacagaattttaatgtcgatttttctaacttttactcggaaatccaaaaaattcaccatactaatctcgaactaatgaatgaagtcatacaacagagagatttttcactagaaaattctcaaaaacagtataatacgaaccagaacatgcaattaaaaatctctcaacaagttttacagactttgaacactttacagggctctttaaataattataactctaaatgttccgaagttatcaaaggcgtcaccgaagaactaaccaggaacgtaaatacccataaggcgaaacacgattctactctcaaatcgttattaaacattactactaacttattgatgaatcagatgaacgaactggtgcgtagtatttcgacttcattggaaatatttcagagtgattctacttctcactatcgtaaagatttgaatgaaatctaccaatcacatcaacaatttctaaaaaatttacaaaacgatattaaaagctgtcttgattcgataggcagttcaattctaacttccataaacgaaatatcgcaaaattgcaccactaacttgaatagtatgaatgttttaatagaaaaccagcagtcaggatcatcgaaattaattaaagagcaagatttagaaataaaaaaactgaaaaacgatctgatcaatgagcgcaggatttctaaccaattcaaccaacagttggctgaaatgaagcgatattttcaggatcacgtttccaggacgcgtagtgaattccacgacgaacttaacaaatgtatcgataacctaaaagataaacaatctaagttggatcaagatatctggcagaagacggcctctattttcaacgaaacagatatcgtagttaataaaattcattccgactcaatagcatccctcgctcataatgctgaaaacactttgaaaacggtttctcagaacaatgaaagctttactaacgatttaatcagtctatcacgcggaatgaacatggacatatcctccaaactgagaagtttgcccatcaatgaatttttaaacaagatatcacaaaccatttgtgaaacctgtggcgatgataacacaatcgcatcaaatccagtattgacctctattaaaaaatttcaaaatataatttgttcagacattgccctaacaaatgagaagatcatgtcattaatagatgaaatacaatcacaaattgaaaccatatctaatgaaaacaatatcaatttgattgcaataaatgaaaattttaattctttgtgcaattttatattaactgattacgatgagaatattatgcaaatctcaaaaacacaagatgaggtgctttctgaacattgcgagaagctacaatcactgaaaatactgggtatggacattttcactgctcacagcatagaaaaaccccttcatgagcatacaagacctgaagcgtcagtaatcaaggctttacccttattggattatccaaaacaatttcagatttatagggatgctgaaaataagagcaaagacgacacatctaattctcgtacttgtataccaaacttgtcaactaatgaaaattttcctctttcacaattcagtccaaaaaccccagtgccagtgcctgatcaacctctaccaaaagttcttataccgaaaagcataaactcggccaagtccaatagatcaaagaccttaccaaatacagagggtactggacgagaatcgcagaacaatttgaagagaagatttaccaccgagccaatattgaagggagaagaaactgaaaataatgacatactgcaaaataaaaaacttcatcaataaggggatatagccattgtaaaatatttgtatcactatatgcattgagtgtaaactgttgcacctataaagaatgaaaacaatctagtatgtgtacttacataattacacagtcttttttttttttaccttgtttatccttcttgttcttcaagcttgtaggtttttttgactcagtttttactgcaggaaaatctttacgaatcatgtttgaactgcccatatttgataaactaacttcttgctttgctgccatcgactgctcagcaacttcccttgacattccctttgctgaggaagaacttttcctgatgcttgtatcagaacccgttttaataccatttctattcgtgtttgaattcatgttaatttgcaaaccttgtggctcacgatcacgttttggatttccagtaaagaatgtttcagattttgaagaaactcttgaatttgaccctacgttacttgtttgactgtccacagtagagaataaattcaaagtactgatacttttattttttttatgctgttttttaccaatgctggctagtccaccgtcccttgagcgtagcttattaatcgccctcttgtcctcgttccctgcagctttctcgtaccatttccatgcgtattccatgttacgatcacagcccttgccatgctcatagaagtagcccagagtgaattgggcctttggcaaaccagcattagctgcacgcaaggcccattgaaaagcctcattttcatctttttcaaaagcaggttctgctcccagtaagtaccatgcacataaacctaacattgccacagaatcgccttttaacgctgcctgcgtataatagtgtacagaaagtgatgtatcctgccctactgtatcattacctgtttcataaatctgtgccaacaaagttgctgaaggaacatgccctaaacttgctgcttgaatatatagttccattgcatacttttcatccggaatgacaacatctaagaacccttcatgataaatcttagccaattcgtatggtgctgcggccgtcaactcattagctcttgctgcagcccttgataaccattttaccccatttaatttagtattaacgtcggttggaagacccattctgccgtagaatgaataaagtcccaatttatacattgctgagggatgattcctgctagccgcaaactttaaaaaattgactgacttacgagaatctcttgttgttcctagtccttcttctaagcaatgcgatgctctgtaagcactttctatatgaccatgctttgcagctgcttgaaataagacaaatgcttctttattttcaatcttcccaaatgctccggatgagtagccgtccgctaataagtattgggcatctgaataaccctttatgctcagtttcttcaaataactttgcgcttctttcaaaaactgaagttttaagtcagattggctgacatttccttccttgtcactatcttgaacaagagcattggaagattcaatagtcagtgcggtttgtaacatatattgcgcatactggaataacacttcaggatctttagattttttaacgttttgtctatacatttctattgtttttagccttggaactaaggaagtattatttttaccacccaaatatcgactgatcatctgatgtgacaaatctgctacagattcattagtagccgttaattgggtatcactgctaccattcaacaggtacatgtgagacaaatctacagaacgagttcttttctttatttgctccttcgtaagagatgtactcgaatttgtctgtcttaatgctcccggtgacggagaatttgtaggagtacttcccaaagaacttaaggaagtattatttgaattattaagatgaagctgtgggggtgggactggaacgaaatcttcctcttgactattgcctatatcgtttgatagtagaggtactgacgcagctctaagatgctcattgataagcggttggtttgccgaccgcttaggaaggtctgcggtactgaagtcttcattgtccctgttttccctattctctttattatctgaaaaatcttgacctaccttcaacgaactgttttgaaactgtaggcccctgttatcaaaatttatatgctgtgattgcattaaatgcttcttatatggatgtacctgcggtgaacttgccattttttatccttttattttaactttatcaccaaaaaagacgagaacctggtagtatacaatggaaggcttattaacagcaagtctaaagtcaagtgccaacacctagtttgtctctactcttaaatcttacatcatcctcgagagggtctgcagaaagaatttttcgttctttttttagcaagtcaaaacgcgaagtgaaacgtgggaaaatataacgatgacctttcttaaaacatgcatgaagactcgtgaaagtcatatgtacatatgtcgtatagatttgcagatagttgcaacaaataattagcgattagttatggcctatacatggcagctaagtgcgatggcatgttcaaatgtattatattaaatcaaatgaacttaaaatgcgatgtttgggtgcaaaatatctatagatgatagagacggttcattgatcttacggatcaactttgagatcagtaaggctgactagatggtacaattttgtgcagtcaatggactattaagggatcgcaaagaggtatgtgcgccagtttaaacgaggtaaaaaagaatgacacctatggggtctcacaaaagggctacaatgacaatttcagtgaaagtgagggcgtccttcatggtagtaagtcgatgcccactagcatgaaaaatatgctacagtctcccacgatggtcaacatgtgtgatattttacaaaacaaggaagctgctaatgacgaaaaacctgtgatacctactacggataccgccactgcggggactggtactgaagatattagctccactcaatccgaggaaactgatcagaatagtcatcttattgcctcagagatcttggaaggcactttcaaagatgtatcttacaaggaatatgcaaatttcttgggaaacgataacaataatcaagtcttgactgagtttgtaaagttattgagtcctttgccgtcgtcactattagaaacgcttttcaatttatcgaaaagtatatatttcattgcagaagcgcaaaatatcgaccggatactagagtgcttgagcatagaatggatagcttgccacccgaacacacattggaagtcaggctataagtcatgtcatatagtcttattttccctgttgatccttaattcggatttgcacaacaactttcaagttgaccataaaaagattaagttttccatggttgcatttatcaacaatacactgagggcactaagagaggaaaatgaatacgaagaattgaaaatatactcccgcgaacatttgatcatcgaagaactttccgaatactataaaacgttaaatgaaacgcctttaccgttatgcacagaatctagaacatcaataaatatatcagataaccaatcttccttgaaaaggttctctactctaggatcacgggaatttagtacatcaaatttacgtagtgttaactctaattctactacactatattcaagagatggtcaagtatctgtacgagaaatgagcgcaaaatcaaataaaaactttcacaataatcaccccatggatgcactctaccttaaagagtcttttgatgacggtttaattaccgaaaacggctccagttggttcatggacgatttaattcttataagcaagaaatctttaccacgtaaatattctaaaagagacaaagatcaagtggcggcaccaaaaatgacctctaagagaaacaaatcgttcttcggatggctaaaaccatctaaaacgactacacttattgagcacacatctagaaggacttctttatcgtatttgaataaggattctgaatgggagagggtgaaaatacaggtcaaggagggcagaatttttattttcaaaattaaaccagatgttaaggatatcatccaatcaagtgaaacagacagtgctaccatcgactatttcaaagatatcagtagctcttattttgcttactcactgcttgaagctgaagcacatgtcgtgcaagataatataattataggtagtggagcaatgaaatcaaatgtgtgtaacaaaaacaccaagaggaaaagtggcaactttaccgttagttttccagagaatatcaacggaccaaagcttgttctggagttccagacgagaagtgttgaagaagcccacaagtttatggactgtatcaacttctgggcaggtaggatttctccagttcctttaacacaattcgaagccgtatctaacgcagaatatggatggagtgacaagatcttgacagagcacgcttccctcaatcttaaaaatattgttgtaagtgaatggaagccactattggggctagagctactatacgaagatgcgaaagatgtagagatggtcgaactaaaagaaaggctaaaggaattgatgaacttcaccagacagcttggtatatggatagataaacataacgaaataaaggataagctggtcgaaatttggagctttgacgataactattttgaagcagtcatgaataattggaattcgagatatttgtatatgaataatcaatataagaaacgactgagctacttgaaagctttgcaaaaagccatgggttctgttcagttctaagtatatttaaagatataaatataaagactgcgctgaagaaatataaacttgaaaactgtactctgccttttatttacaagggatattgagatgatttgtgtgaatgaagtagcgacagaaaaaaagcttttatttcgagttcgcatcattgtcactttcctgctttttcttggcgtactgtctatctaagatagtctttaatatagcgtcctcgccatattcttcttcctcaattttcttccatctcttttctacatcagctctctttattctactttcaatgacagcacgtttcttgttattcaaacttgcctccttgagacacttgttcaaagcatccttttcgttgttacaaaggccaaatattctcttgtaatattccttttgatggcatttatcgagtgcattgatgaagtccaaacaggctaaaatgaagaaggggagaatacaatgttagtaagtcggagcacagaaaaaggcaaatatatgaagtaaaatctggatacttacaatgaaaacgttcagcttctaactgtggatgcatgttgtagtacttgtcttatcttgcttttgttcaactgcacttgtaaatcagtgaatgttattggacgcgcagcgattttttaataggtctttctctattaatgtaatatgcgaattgaaacataatgtaaacacaagaagaaaattcgaaataaaggactggccaacaataatgttagtgagcagaaacgacaagcccaaaatcagtagtgaggaagtcacacattttatagacgactataaaaagaggaggaaaactcagatgacacgattcttcggaatcactatttttacacttataacatgtagaattgccatgaagaaaatgataactgcaaaaggtatgcataggcaataacttcggcctcatactcaaagaacacgtttactaacataacttatttacatagtgccattgaacacttttcaagcaaactacgccagccggacgcagacaataacacacacacaaaagagtcttgcaggttctcttttagcggcaacgggcatgacactaggtatatttggtatgggcatcacagggacatgttggagctgggatgtttcatcatttcaggaactaaagcaacgtctggaaaggcgtgccaacaacgaatttgtagtgacaaacatgcctctggataaaagaagccagcaagtagtggacagcttagttaagacacacaattcatctctttgtaaatagtgttataccatagtagtagtttcaataatatattccactacttatatgtgttacccgcattagaactcttattggtggcgaaaatcgatggcaataaagaacggaaggggtttaatagttgtatgcttaacatatttcgatttaaatatataagaaacgtcggtagcacaacaattaactcattatttaggtatggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgttggtgggttatgtccaaaaccaggatcctcacaaggtagcaacgagtacttgaaaaggaaaggttctacctctcctgaaccaaccaagggtagtagccgctctggaagtggtaacaactccaggtttatgagcttttcggatatggtaagaggtcaagctgatgatgacgatgaagatcaaccgagaaatacttttgctggtggtgaaacatccggcttagaggttacagatccttcagatcctaattcattactgaaggatttgctggaaaaagcgagaaggggtggtcaaatgggcgctgaaaacggattccgtgatgacgaagaccatgaaatgggtgccaataggtttactggaagaggttttagattagggtcaaccatcgacgcagcagatgaagtcgtagaagacaacacttcacaatcacaacgtagaccagaaaaagtcacaagagaaattacattttggaaggaaggttttcaagtggccgatggtccgctttatcgctatgatgatcctgcgaacagtttctatttgagcgagttaaatcaagggagggctccattaaagctcttagatgtgcaatttggacaagaagttgaagttaatgtatataaaaaattagatgagtcttataaagctccgacgagaaaactgggcggtttttcaggccagggccaaagactaggatctcctatcccgggtgaatcgtcacctgcggaggttccaaagaatgagacacccgctgctcaggaacaacccatgccggacaatgagccaaaacaaggcgacacctccatccaaattagatacgcaaatggcaaaagagaagttttgcactgcaattccacagatacagtaaagtttttgtatgagcatgtgacatcaaatgcgaacactgacccatcgaggaatttcaccttgaattatgcctttcctatcaaaccaataagcaacgatgagacaacattgaaggacgctgatctgctgaactccgttgtcgtgcaaagatgggcatgagcataaatatacaaaaacagaaacgggaaaagacttcaacttaatatataaatgcacgtatatctatacccgtagtatatatcatttgtacctcaatacaatttcaaatcacctgttatttgatccaatactgcttttggagcaggtcctaaacccaatacggtggcacttcccgcagcaatctgtgttctaccagcatcatgaataactgctgcattcaccccaagtgatatagccttcgcatacaactcgtccattgtaaacttatctggacatttcaacgttattttagcctgtccagcatttagccatctttgtgtcataattgggttgtatgaagcacgcgcggggtttgtagcaatatgtctaaaacatgacaatgctgcgtgacagcattgtgccgctattttgccctttgtcatgccaagatcttgacgaatcaccaatgccatcctaacttctccaggtatatcattcaatgaagtggactcaatatcttcgtcctcatcgctctcatcttcgctttcactttcctcctcatcagtgtcattgtgtagctttccttccttcatttctttagaacgcagtaaagtagctgaggatttcttagttgatgatgcgttcgacgtacccaactggtaacccacggcaaaggagattgcggtgaaagtagcccataaagctatggtgtaattcgaagaaactgtcatcttttccattaaaaaggacgttatcatgttactccgctgtcaacaagtaatatagcaagaaacaattagctcttatgcttaagagcttctagaagagtagtaataacctttaaacattattttcgtcaggcgtgatatcagcgagttgaagaaaaaacaacatgggttgtccctcaagagaataaactcaaaggagtaaaaggtgtttagagcttgttggctcgattgttgccaccggaaggcccctttctgtttttagactatattcattttactttttgaagtttctattataggcagacgaagaaggccaagaagacaaatcgaagaaagagagagataacatgggtcaaatattgtccaatccaattatcgacaaagagcatcattctggtacggactgtttgacagcgtttggactatgtgccatgcaaggctggcgtatgtccatggaagatgcccatattgttgagccgaaccttttggctgagtctgacgaggaacatctcgcattttatggtatatttgacggtcatggtggttcttctgtagcggagttttgtggctctaaaatgatatctatactgaaaaaacaggagagcttcaagagcggtatgttagagcagtgcttaatagatacctttttagctacagatgttgagttgttgaaagatgaaaaattaaaagatgaccatagtggttgtacagcaactgtgatattggtatctcaattgaaaaagctactaatttgcgccaattccggtgatagtagaacagttctatctactggtggtaatagtaaagcaatgtcatttgatcataagcccacattgttaagtgaaaaatctcgtattgtagctgctgatggttttgttgagatggaccgtgttaatggaaatttagcgttatcaagagccataggtgattttgaattcaaatctaacacaaaattgggacctcatgagcaagtcgttacatgtgttcctgatatcatttgtcacaatttgaattatgatgaggatgaatttgttattttagcatgtgatggtatttgggattgtttaacttctcaagagtgtgttgacttggttcactacggtataagtcaaggtaatatgacgttgagcgacatttcatctagaatcgtagatgtttgttgttcacccacaactgaaggctcaggaattggctgtgataatatgagtatttccattgttgctttactaaaggaaaatgaatctgagtcacaatggtttgagcgtatgagatcaaaaaattacaatatccaaacgtcttttgtccaaagaaggaaaagtatttttgatttccatgatttttcggatgatgataacgaagtgttcgcaataaccaccaaaaaattacaagaccgcttgaatcgtagtaaagataatgacgacatggaaattgatgatcttgataccgaattggacagcagtgctactccctcaaagttatcaggtgaggatagaactggccctattgacttgttttcgttggaggctctattagaagccgggattcaaataaggcagaggcccagctccgacagtgacggcaacacttcttatttccatggtgcttctttatcagatatgttggcatctttaagcaatgcggctgcaggagaaacagaacctaatgatgctgatgataacgatgataacgacggcgaagaaaacggcaagaatgaaaatgcgaagaagggttccaagattgaagaaattgaataataaatattgtcgaaccgtactttgcaacgaaagagtagtcaaactttgttatctttatttgttattcctcttctgccgatggattgttttttactggatcatctttgcggcccatattgaggagatggtgaaattcataaaaatcattacgagagaatgataaattgtaacagaatttataaatcctattcatatagatacatctgtttttccttactctgtttttattttgttggtaacctttgaatcctttttgatgaaaaaaatagaaaaaaaaaaaaaaaaaaaatgaaagcaatatcgactgtatgtatatgcgcaccataattttcctattaatagtttaagcataattagtgtacttactaaaaataatgtaactttgctctttgcaccaatagatgttactctccaaatatcttacaggtcgtcttccacgtggtatctatcaaagtagccagatccacgtccttgacttccgatacgacaattgctacttgttccatattacaaggctcattacggcccttgaccatgtaaagttcttctgcattcaacttgtcagcgagcttatttttcttaacggacttgaatgcagggtattcgaaatccctaacctcctggtatttggctaagtactggaaagatgcatgcgttcttttaatctcacaccacggagcatctgtctctaataacaacctttctgttggtatttgctttacaacagctagattttcctcggttctcaacgagcaaccgtttactcctatgaagatgttgggtgataagttcagtaatttctgcaaatctatcgcagaaccagtgaatgaatggaccactagttttctatctggatgaaatttgtaaaacccgctagacgacgatgcacctaacttttgtagctgaaaggtatccctctcatcagtgaacccggcaataaatctttccaatatttgaacaaaatcgtcacatgcgcttctcatatgcagaaacaatggatagctgctgagtttatcgttcaaacaacttattttcagttgctcttcaaaaaaaaccttttgcatctctttagaactatagtgaaatctgtcgtagtccaacccgatctcaccaattgacctgaaacttgtatcatgaggttttgcttgctgattcatcaaatcataaagctctttcagtttaccctgtgcaaaagatggattactaataactttagcatatagagactcattatatgcttcatccatggaagggttatcaatagaagcgctagccttgtccccttgactagcatccgcaaactcgttaacgcaacatgggtgaacacctattgtgtgatacagctttaacgggctaagatctttgacgctgcttaccaactcaatggcactttgagactccgctatggatgatcctgtaacaagggcatttttcacgtgcctctgagcagcacgctctaataattttacataatctgctggatggtactgcttaccattgtaaataccgtgaaacataggatctgtcagattcaatccaatatcatagtatttcagcggagaatccgtggcagttgatgtcatgctataatattgtgtcaaaattggtttccagagcctagaacaacttttgttcgaggatttcaataagatgccccacatataactataacagtactggcgcctcaaaaaaatgccttggcagcgaaagtgtccacctttagttgtccattgctaccaggacatcaccactgggcccttccagcatgctggaaagattgttcttagaagagtgctgttctaagtaacccggcgttagtaggggctaagccttctagaaggccggaaaaggctcagaaatgcctgcagtgcaaagcttttcaggaacgttactagcgcaagtcttctggctgctgtttagcaacctctttgcaggtatttcgcagcgggatttcgcaggtgtcttgcctagcgtatcaacacttagtagcagttaggttctaaagttaaactccacttccgttcttcttcgagttcctttttgagcggtttggcctatcttgtctcatcatcttgttagtgtgcgacgttatctgtgggtgagagaggctatttttggtccggtgaaaaaaaaattttttctctgctgagagctgaaatttgaaaattgagatgagatgcgatgcgatgagatgcgagaccaatgcgatgagacacttttctacttccttacacagaagtcgtgtatagtttttgtacgttgatattaataaaggcttttcatatcattttgttttcaggtaaacaaatctggcaaatctccactgcttgagtcattaaaactactcactcaagaaggcatatacacgacagtgggtagagaaaagaatatatcactgttcttattgaagttccctcgcgatgacgttgccgaaactcagtagcgtttctgtttcatcaggacatgttagtgccaactcacatggtttctcaatactaagcaaacaccctcacccaaataatcttgtccattcccactcactttctcacacaaatgcgaagagccacctgcctatcagtagcactagcactaaagagaacagcacgaacaaggaggaggcggaatcactcaaaaaaaacaacccctcttcttgggaccctagtgatgatatcaagctccgccacctgaaagagatcaagaacttgggctggaaggagattgcacatcatttcccaaatagaactcctaacgcttgtcaattcagatggaggagactgaaatcaggcaacttaaagtctaacaagaccgcagttattgacatcaataagctattcggcgtgtatgcgactggtgatgctaccccatccgcgggtactccgtctgcggaagaagccgtaaaagaggaagctgttgaggatgaagatattactgcaggttctagtgctatcgaggattctccaccggatttcaagccattagttaagcctaaatacatggacagaaaactgataactcaaagatctacatcaacattttcggaccatgagccacaacacacgaaaccaaggaaactgtttgttaagccaaggtccttctctcattctataacaaccaacacgcctaatgtaaagactgctcagcagacaaatctaagcctttataacactacttcagcaaagacaaataaagctgttaattccaatgattatgagaatattggtcttgtgcctaaaattattatcaggtctagaaggaactcctttattccttcaactcaaatccctcattcaacgacgaagactaggaaaaactcgcattccgtaatttcttctagaagatcatcttttaacatgatgcattcaagaagatcatccttcaactctcacgctcctacggagcctatttctagaagagcttccttggtagttagcccgtatatgtcacccagaaggttatctacatcgcaatccgttcattatcatccacagcaccaatactatcttaaccccatagcgtctcccaactgcaagacagaccacgcaaatgacaaaatcacgcacacgaggactttcttagatatgcaaaaattcgctaataaacacccgtggtctagagaagatgatgaagtgctacttaacaatacgaaggacaaacaaaaccatttgtcgccgctagaaatttctattgttctgcctaataatagatccgagttggaaatccaacaaagaatggattatttaaagagaaaaggacgtgtaagtggttttcatacaaatgaaggatgcaaagacgaggaggaggaggatgacattgacccactgcacaaggagaatggcattaacacgccatcgcagcaatcgcaaaattacggtatgttagaggctaaacatgataatccaaagtctagtgagctttcttctatgaccagcgcaaatgacatacgcaatgagcaagatgaacttccaggtataaattctatctttaaaaatatattttaagctaagagacgaatttagtttgttttgactattcgtttaatgagtacaaattaatcgcacccacacatgtacacacacacatatatatctttatatatacacataaaatttattcgtaggagaattctgtaatactattgactacaagggttcttattgctattaataatgttacatgtatatgcttatatccaatatatacccatcgccgcttattcttcgtcatcctctattagagttatttttcttctttttctgactctctccttccttatgtggctttctatatcgttttcatcctgctcttgtccttttctcttcccatcctcatcatcatcactgtcttcttcatatgtgtcttcctcctcatcattttcttctgatatttgctcatcctcaatgtcatcatcaagggtaaagtcttcgtcttcgtcttcatcttctttggcgttttcacctacatataattcagtatctacatcgttttctacttcatcctgctctaaacttgatattccagtatcgtttctcctagctgcatgatttccaagtggtgtttcggagtttttaatagtgaagcagagctcccaatgagtttctgtactaaattttgatcttggtatccctttgcgatcatggatgctttccagcactcttttttccgcttgatagattaatctatcattatttgtgttcttataatcacacatatactctgttaaggaggaaacagtgtcttcaaaaaaatcagtagcaggtacttccggttctatgatattgtttacatgaagcttggatgttttgtgctcactacttcttcttcttcttcttctgcgtttattatgtgctctactgttgttatagttttctatatgtgtgttattcgaaattaccggagccatagtttcatttgtaagagcttcgtccgctaatgcggtgggttctaagttcatcatcccatttataccaaatgacggccctaatataataggttcccacaatagtttgtcatatttgacgcgaggatagttttttgagctccaagttttgtaaatattttcaatcctgttccaagaatcgattttaataatatagttgaaatcatccaaactggataatgagcgtgttttatggcgatacaaaacttgaagttgttccaatccaaacacaacgtctgttggtatcattcctgttagtttagcgatatcgtttaggctaacctgctgaaaagtatcttcatttttattatttgatcgacgtctagcactgtctcttaattttaatagcacttcagcacattttatcttccaaaacgttctgtaagtcaataatcctaaatccgacaatggtttttcaggagttccaaattttgactcctttctggataataaatatgaaaattccatcaaaaactgaccatatcctttcctctggtatatgggtagagttaaaatacaacttaggttatagtcattggagttgaatttttccttggagaaatagcctacgaaatggaatttggctgcgttttgatagggatggttctctgtatcctctctctccgttagaatatagaatataaacggttcaacatcgtaatacaaagtcttagaattgataaaacattttgccaacaggcaaagattttgacaatacaagacattctcccgcccatcaatttcccaaacagacagcttaccgtcgcgataaatttcatttccggggggcttaaaagttagacactttagttggtgtctataaaaagtatatcgagaagtcatatattttaggcagaactcacatataaaaaccattttattttggttgatgtgttccggaaaaggagatgtataccaaggtttaatttcataatttcgaagaacaatgtattctatctgggaaaaccacactttatttttgattcttggtactttccctttcctttttttcctatcttcgttttcttgatcggtttcattatgattgcaaagtgatacgttaccattaatgtacgttgcagacttagagttttctaaaaatgtaagaaactttattttatcttcccaggtgggtaaagttctttttgtactgaaatctttcattttttttattgttccgccgtatggtacgtaccattgccaagaatcgttatccctgaatggcgtattatcagaagaatatgggtactccatgttttcggttgctagatcccatgtttgctttaacctgttaactcttctttgaaacccgattagaggaccggatgatgttatatttttgttaactaaaggtgctatgactgaagatttagatattagtctttcaaaattgaaaaatttgatagaatcatacttaattctaaccttcaactcctcgctgacttcaatattaggttcaataatggggaaacttactgctcccatcttattgtccctattaacgatattttgagaagaattttctgacgcaagtttggactgctgggaaatcaaccctttttttattttattaaggcctttatcagaccgaacacttcctcttattcgatgtgatatactggcatcggagttgaatagtcgtcttgtagttctatgtccatttgtatcgcttctgacaaattgagaatgtatcagatcatcgatctctaagtttttcaataatgcattttttttgggttttggcgattcgtcgtttgctgttaatgacattatctgcaaattatacggagactaattaatgaagaaggaagaagagagagggcggtatgaataacacctatgagaaaagaatagcaatgcttttccttttttaccttttatattcgttctttcttcttttgcctcttttaatatgctttgtttctgtgctattttcccgactctttatttcaaacaatgaagcccccaattaatcaagaaccaccaaaatagcatgtcagttgaacactcaacgactaaaaaaacgaataatttcttgttcaattggcctgaacgtttgactatgaaactttctgctcttctctgatcattgtaaacaaagaaatgtcaataaattattgttacccgactttctatatactacaaataccgccaatgatgcagtgagcaagatatcaattaatgcaaaaacaatatcgagtaaggtagaaacatctctgtgattaaacatcgtacatataaataccatatataaaagtatgtgggaaaagaacgttcaaaaaaaaaaagtaagtagtaggttaaaaataaaatctcaaaagagggaaaaaaaaaaaagagggataattttggcttgattacattgcgttacttaaagtagcctcatcattcattcattatcatcgtttcatcgacattaggtgacgtttctcagtaaaaattaacttcatcatgatcattaatttcatattcatattcggttatttttttttttttttatattttttttcaatggtgtttttgatggtttttattatatatatatatttttttatcttttatcttgtgtaagcacccctcattacttgtatcgtgcgatatacaaataccaaacaaactctataatcatagaataatggaagtatatattaccatagattcttcttgttttggttttgtaaatccagtccgcttaaagaacgattcaagccctgttccaagccatcatctagtccagagtgactcaaagatttatagatcaagtcggcactattcaaattgtgtgcggacaacatggactcatcgtgataagactgatatgagaaattagaatgtactgagccatttgtgtgctgtggaagcagttgggactgtgagtttgctgaagatgggccgttaaggttgtacaactgctgggaagacaatgaagcattttggtatgccactggtacccgttgttgagtttgggactgtgctggtggttgcgcttgggatagggtttggctgttgattgggatttgtgaatttggaggtgaaatttgagaatttctcagtaagggattaacggaattgatttgataatggttggcagaataaccggatggaattcttgaggatggtgttaaagtagcttgttgtcttaaaaaagattgttgttgttgcgcagctgactgaacattttgctgtgtttgtggttgaggttgttgcggttggtctgcggaattgtattgagaactatggtgtatgttcattttaggtgaggttagtgttggttgcatggagaattgtccctgtgaagaaatttttggtgttgagctggcgctattgttattaatgatgacattgttaccgttaccgttattactgttaatagtattgctgttggaagaattgttaacggcctgattgctaatactattcgctgcagctgctgcatgggcctgtaacaaacttgtataagattgtgacctattcatggagccgccagtggagtttggctgcaaaggatgagcagatgtcatttgaccttgttgttgcaaatgagattgtaaattagcatgatccagaatctttcttctgataataataaatcttggatcatatacttctactagccctaagtacgagcacaaaacattgataattctcttgtgggaagcggatatacccatgggataagccaactcgtaataatacttttctctatccttaaataacaataattgggaataaatttccaaagtgtcagggtcattgaagtccagttgttggggtgggagaggcaaagtggaagttgatggtaaaggcgcataaaatctctcagtggacatctgggcttgattattaacgtttgtttggtacaacgatgaagaagtatgttgggcagaaagtgaaggttggttcagaatgatgttaccactattgttgttattagaactgttattgttaatggtattattcattggactgttcatcatgctattagcattaatgccgttcattagagtcgagaataattgattgttagaagtattattgtttccgcttccactcattttagataaagaatccaaagaaagattagatgacgatctgtgttgttcttctaattgtcctcttttctctctcttctccctctcgattctttctctttcagcttggggaagcatttttttatattccactttcaatttcctcccgctgatttcctttccattcaaagaagttatcacttgagtagtttcttcaggagtggtgaaattcgcaaaggctagtcctctgaaaataccgttatcaaagtggtaattgaaggcataaggaaggggaagatccatttcttcaataatgtctaacaattgctcttttttaatagcaaacggaatgtttttaataacaatagcatttgggataacatcatcgtccaaagcaccattggtgggggcattattcaaatttgtagaagaaacgttttgttcggcattttttgcagagttctcaccagtttccgtttgcacaccgttttctttgtcaattgcatctctagtttcgatagattgctgatttgtttcctggtcattagtctccgtatttatattattatcctgagcatcattgatggctgcaggaggagcattctcaaaagaactggtctccatttcttattgttgttgaacacgctttccctagtctgtagcctgcctctatgagtactatatcacacttcttcttgcgctaatctccaaagacctgctggtaatctcagctgaaaggctgcctttaattgttattcttttccaggaaaaaatcgcaaagttgcagcatccgtgtttcgtgacatcattgaaggttaccctaatctattacctcggattaacttgaattaataaggacacacaggtatagggaaggtaaagttgaagtaatgataagaagtgggcagcaccgaagcagtttatctgaactaacttctgtacgactcgagaatatagtaagaacaccatcattaacctgaaagttaaaaatgtcagaccctgtagagttattgaaaagagtatgtagtagggaaatatatcaaaggaacaaaatgaaagctatgtgattccgtaatttacgaaggcaaattactaacattgaaatacgggaattgatatttcccgttgtgttaaggctgagaagaagggtgttccttcatcgggtttcatgaaattgtttagcggttctgattcatacaagtttgaggaggctgctgatctttgtgtccaagcagccaccatttaccgtctaagaaaagagttaaacttggcaggagactcgtttttgaaagctgctgactatcagaaaaaggctggtaatgaagacgaagcaggaaatacctacgtagaggcttataaatgctttaaaagcggtggaaactctgtgaacgccgtggattcattagaaaatgctattcaaatttttactcatagggggcagttccggagaggtgctaatttcaagtttgagcttggagaaattctagaaaatgatttgcatgactatgcaaaagctatagattgctatgagctcgctggtgagtggtatgcccaagaccagtcggtagcattatcgaataagtgttttatcaaatgcgcagatctaaaggctcttgacggtcaatatattgaagcaagtgatatatattcgaagttgatcaagagcagcatgggcaatagattgagccaatggagtttgaaggattacttcctaaaaaaagggctttgtcagctagctgctactgatgcagtcgctgctgcaagaactttacaagagggtcaaagtgaagatccgaattttgcggattcaagggagtcaaatttcttgaaaagtttaatcgatgctgttaatgaaggtgatagcgagcagctaagcgaacactgtaaggagtttgacaattttatgagactagataaatggaaaattaccattttgaataaaattaaggagtccatccagcaacaagaagatgatttgttatgaacggcatatacttacgcgcacatacatatatacatatatattataaatgtaacacttgttttacccgaaacggcgaagtaattgtgtaccgccgtgcaccttttcctcgagataaacatatagcgatgacttagagaacaaagtagtattagtatcatatacttccaacgttaatcaagcgcaataaacctttgttcgtgtgtttcaaagttattgcaagagcgaagttgaagccatcttttcacgagaagttagctgtggttcgagtctgtcgcacgccgtgtaatgtaaggatcttcccttagcttttctgatccggagcccttgagggatattacgcatcgcgtatcttcatacgattactgtactttgctgacttgcattcttgatattgggctatagttggcacttcgctcgtttcttttctttcgttatataacgtaacctttttttttttaacttccttatcctgccccttatcactctgaaccccatagataaacaaagacagaactctgtcctactttatctattactaaactcaacacattacagcccaatattataaatacgttcttcttcgttacaagaataggcgaggttgtacgaactgcaaactagctgcaaattaattgtaacacttaagtggagagcagagagtagcagcactgaaggaaaagggagaagcttatcttactgtagaagaaaatgggattgcgttactccatatatattgaaaatccgttatcttccccatcatcatcgtataaatcaataaacgacccgttattccactctcagcatcgatcgcaaaaaaacgtgagcttcatcacctacggttgtagacattgcaagacacatctttccagttccttccagattatttctagagattataggggtaggaccggaactgcttatttaatgaacaaagttgttaatgtcgttgaaggaaaggtcgagcaacgaagaatgttgactggcgactacttagtctgtgatattctttgtcattggtgcaagaggaacgtaggttggaaatacttgcagagcagcaatgatgatcagcagtataaggaaggaaagtttatcttagagctgaaaaacatttgtaaatgtacttgatgtcttcctttgtctgctatctagcacctctcgtcttttagtgctttttagcgtatgattctttttaagaatctggtctttcttccttctattttgattgggtatatttctattcgtgtttcattactggtctgggttaattgggttttggtttggtccagttgttttcaagtagcctttattttttcattgtggtattttatcttatcgatttatacttttttttattcaaagaaaattaaacagataatctcttatgagcctagctactttgttttttcttacagggccattgacttatgccctgaacgagtcttactttactttttttgtattttcaataatgtcgtgtttcccatgttgtaatacgcccaaagattatgtggtagagctttttttttttttggttagtgtatttaccaaactgggatgattttcaaaacttatgaagcagtttcaatacataactgtctaacgtaaaaattttataaaatggaaaaatagatgatgataactataacaattttaaagtacaacatattctacttttagaataattcacaatatacaaggacgatcctggaaaagggtaaatatgattcagcttcgaggaagaagtacaaaaagaagacgaaatggtccattacagactaagcactatccaacaaaaagttagtggcggcttctagatcccagttgcacttttccaaggcattgtgcgcttcttcttcagtaaatcccatgccacttaactcctcgacggctagagactttggagtagttgcaaccccgcggttaactattggaccttttgacaagctagcatcaacgataggatcattcttcaatggaattggttgttgtggaatgcttggggtagctactttggttggttcagctttggagttaccaaatccagcaaaaatctcgtcccactcatcgttgcttacttgagcagggtcactggttgactgttgttgtacttgtggttttgggatagttgggttagaggaactagttaacgtccctgtaaaagcgttcatttgtagttcgtcatcgagatccttatggtctatggtttcaaattgctccatcgacccagcattcgcaacattctcaaattcagattccgaatcagcaccattatcttcctccacagccgcttgttctaaccctgcgaattcatcatcaaattcgtccttaacaggcaaaatggaattggtgcttgccttttttgagttaccttcattatgtgaaggagaagtgcctggagcgggatattttatgacttgttccgtgtggatttccaaacttgatgtgggctgggcattatagggagtttgaagggtcttcactgttgctgatggaatttctctggtatcttcaaactcatcatcgtctgaagaggatgaatcgctttcgtcaatatgcaattcctgaattggtggaaactcttcatttattgtctttgcttttggttgagcagagatttttggagattcttggatagaactgaccgactcaccgtcttcatttgaattagccctttttgtggtacttccgtcttcaataacttctgtagtttcgttgctcaaaacatcagtagaagcggtagctggggtagcttcccattcaccaggaatgtgagataagtttccagtattatctctattcgcagtattattgatggtgtcacgttcttccaacgtttccggtagctcaacatcatctcttacggattgaggagcattgtttgcaacagacgatgtcaaggattgacttcttggaataccatattcattcaaatcaccatcaaacctatcacttaatgtttcagttaagtttggatttgctgtctcatttcctgactgggtgccgttgtttgtattggcattttcactatcgctttgagatcccaaagttggaacgtctctatcaaatacgtcactttcggttctttctgtcttttcttcatcgtctttaacccgattaacattcaagtttgaattctcaacagtagtttcgacaaatttggatacagtgtcttcgtgaacatttcctcttgatgtggcttctttggttgttgtatctgtattagaggcgcttttcgcaataatgtccttagcatcctcaggtaattgtcccatagctaaattcatttgtctttcggataactctctcacattgttagcgtattcgatgtttctctcctttaactcttgatcagctttttcaaaagaagcttttctctgtgatagatcgtcgaacatttcttgcaatttagaaacgtgctgatggtagagattttcttgttcttcaatttgtctgttacgttcttccaattgtttttcacggtccgttaaatcagtatccttgttggacagatcctggtatttagcttgtaattgtgcgtgttgctcctccacggtcttttggtagtcatttaactccttttgtttagttaagtaaacgcttatcttttcgccaagaccatcgatttccttctgcaagtttgctactgtgacttgattcaactctagctgttttgaattaacatctaccattgacctttcttgcttgacctgttgttgtttttcatttaattgtgactgtaaggaggctgtcatcgagttcaaattcgtaatttgttcttttaattctgcgttctttgtttgagattcttgcaaatcagtagttagttcattgagtttggactcagcggcatggtagtttgcttcggatacagccaactgttgcgctaatgtttcgttttctttgtttacttgaagtacttgtgcttccagttgttccgtttgtttaacattttggtcatgggtagaacgtaaattgttcaatttgatttgaatggaatttttcatctcagtaacacgtttcaactcctgggtcgctcttgactttttgtcattagttatacttgcctgcttggacagggagtttacttggttagataaattagccatttctgtggtagcattagataactgagcagaagcttcaccatctgcaaataaatcctggttcttgaatgcattattggaagatcttgaaaaagcggatgcgcctaaagcagcagcacccactgcggcgcctacagcagcaccagtggcagcgctagtggcagcgcctgctggcatgctaaacacagaaaagttgggaacttgtggcagtgttgttgaagctgtacgtttgactggacttgaagcatgttttggaactggcggaggctgagcgctaaaagtatcactggattcccttagttgctcttgttcctctggttcttccttgattatactttgaccgaagtttgaggtgggagtaaatttcttcaatccagaggaggagtgagttaaaggtggaggctgctgtggctgttgttgttgtaatgttgcttggccattgttattatcatatgaaaaactattatttgtgttgttttgaaccacagtttgtgctttagtgggagaaggagagctgaatgaagggttcaaagccagtaaatcattcaaagaaccgttatttgagttttgaggaagaacttgtggaactgttggttgagtattaactgctggggcagaaacttggtgtggcatatcctgtaaagaaggcttacttgctcttgaggggatggcaatttgaggtgcactttgttgttgaggaagtgggtttggcggataaagtcctaaagcgggggactgtaataattcattggggataacatccggtaattcgacaccagcattctttttttgaattaagaacatggcaatagcaaattccaatttggtgaattcagcattgttgtggatgtcagctaagtcccagatggtggctaacgtctcttggtttaatctagaggataagaagaatggaaccaacacagcagagcttagcgaaccagcatgttgcttatctaatgaatcaaaaattgcatcaaactgttgttttttttcaaaacttaaagaccaatctgaagcagcattactgaatgcaccagtagatagacgtgatatagtagagtgtcttgttagtgaagatacgccagtggagttagcactcaaaggagtagtcctgtttggttgattaacaacaacaggttctaaacgaatagaatcccacagctgagtaggcaacacggccggtggtgtgttcatactaggatgatgagacatacatagttggatcaaatacatggccattataaactcagatttgtctaagacaccggatgcgtctctatcacaaagagcccaaatttcacctaaagtttgatttggtaatcttgcctttaaaaatatatccttggctttatcaccagcaacagtttgagcaccctttgctgtcctatcaaacagttgtgaaaatttagcaatatcatttgaggataaggcaggaatatcagtgttgtttgtattgccggttgcactaccgctttgcataggggctgggttctgatttatagaaaaagaagccagttgagtaggtgtgctctcatatagggcagcggaaattggttggttgggagcattttgcaattgagcgatcattctcaaagcagccgaaaactcgttcaagttcaaaaaccctttattgtctatatcgacggtagcccacacttgcgatagtaattgccctggaagaccagaagacgcgaagagcggtctgactgcctcgccagtgaccaccccgagatcttccgtatccaattggtgaaatttctgattataaaaggcttgttcctgagaggataatggagttctaaaagtaatagatgccatggcctatatcgttcgaatcctattgaaaacacacagataaaaacaggaaaaaagatagatctagagcttcacgaatctatttattagtttcaacgcgctatattatttcgcgagaaccagtaattctctatttaaaagcactctattgcctatcacaaagtgctctgttgtgtgttgttttcaatgtgcttctgaaaaggggtttgtaatagttgaagattttgattataggagaaatctaatccccctccgaagcgccgacgggtaatgattgtgtagtttttcatttcgcgatcaaaagcatgtattttgacacagctaacaatacctattatcattttttgttggtgttctcatcgattgtcaaagcacaataaaaagctatgagctcgacgatgttggatgatgtggataataatatgatgggtatcaagtctatcagcctttatgaattacttagcgatgtggtgaaacagggcgacaagacgcgattggtgacggcgggtcccgagcaagttttgcctgatttaatccggcatatcactgaaacaataccgtttgacctatttataaaccttaagaatgaaatgaacgatgcgagaaatctcgttactagattaaattggctgggtaagtttctgaatgataattttttacaaaatcatacatttccattcacaatacttcggatatgcgaattgtgttatgatcctttcaaatattacaagatcaatgaattggagaagtttgtaaatgcgctagaaaaatgttgcatggtaactagcagttggcaggtttttgataaaacacacggtgagaagcaagaggacgataaggagaaagatattaacttcatcaagaatcaagaagatgtctcactaatgaagataccgtggatgaccgaaaacaatactagggagttggcaccctttattagagaaatcgactctataatgagtgtcaacctaggctacgatgacgaggatgaagaggaaggattttttgatggtgatgaagatagggagatggggaataagagtaagcgtaatgttttgctgaaagatgaaaatttcatggtggaagaatactatgaggatgattgcgggataaacgatgataatagcgataataaaggacaaaattgtcagagcgatgttacgaagaataatagcgatgatgaagatgacgatgacaacgacgacgattatcgtgaagatggtgcagatgaagatgatgaggatgatgatcacatgggcagcacagatgacgatgaagatgatgacgaagataggcaggcgggcgaaagtaccaaggtgcaaaattttgacaagaaaaatgaaactccaaggaagaggaagcccacagatttagataactttgaatatgacgaatcaccatcattcacaaacatggatctcacgacgccaaagaaatataaacataccgcaacgggcaggttctccataatagagtcgccatcgtcttcgctcctcaatgccatggacggcagtaatgagatctcatcgagccaggaggaggagaaagaggatgctcatgaaaaccatgagggtagaagtgaaggactgttaccaggtgacgaattagtgagtccatcgatgagctcttcacaagaggataagatggttgcgattgctggtattacctaccgtgagaatattagcagtccattaggcaagaagtccagatgatcgagagatgacttctctaccaacaacttcccatttgcataatatcattaaatatgttttaccaaaaaaaagttcatctttcttatttttaaaatcgatagttcttcaggatcttggtcacatatatatatatatatatatatacacttatataaaataagacgtttatttaatcttgttttcttacgagtttctttttttttctttttttattttctacttttgcaaggaacagtgaccttgccaataaataatgaagactacttgggttactagaatataaaatacatgtaaaaaattcatttatggtgtgagtgtgcgagcgtgcctgtatacatctagcagcttgcttatttctattttatgtgcatggaaaatatattatcacacatcttaccatctcatcatggacatgtcacttctgattctcatgtaatctaataacccttcaatttggcctgtaccagcaatagcaatatcttggtcccataatctcttaccggcccaagccttaacatctttgactgtgattgcatcaattttcttgaaagcctcacccagagacagtttggagcccttgattaggacttctgcgcctaacaagttagcgtcattgacgggattaccagattcgtataactgccctaattgtaatttcaacagcgatttggcacgttcaacttcagtatcagtgacagaaatggtcaatctgttccattgtttcaaagtgaaatggatgaggtcgtcaatcatggtaacgtttctcgtggccgtagagaacccccataaaccggaatctttgtaagaaagagagaaatgattgaaattgtcgcataattggtactcctgtatgttgtctaacaatttgataccttgtaatctagaagcgggttcgaaggcgttgtatgagccgaaaatttgggcggctaatttagcaacaaaataatttggtgaattgacaggttcaccttccacagccagcgaaatccacgcctttggcaaggtgtcgtctctcaatctaacttcggaacccaagaaagcggcctttttcttgagtacgggcttggtaccggtttgcaaacttaggtttttggattcgatggaatttactaaatcctcatgtttgatattaccggtaccaacaacaacagcatttgaattcaagaaatggttattggcaaaagattccagatcagcaacaactaaattctccaaggactccaaagtacctctagtaggcaaagataatggagtgttttggaaggcggtggagtgtaaatgttccaaaactctgttgggatggtcgttttcttcaaaatcttgaacttgcttcaagacagatttcttcgtggcctcgaagttagaagaagatagcaaattagccttttgttggatgaaagactgattcaagaagtctagtgatttatcggtagaacctggcaaagaagatacaatgtaagattggaagtctctggagatattggaagacaatgccaaaccttccttggcggcaacagcagagttttctttggatagaaagatgttcttccataaattggaaaccccgttgttataagggttttcgttggcagcaccggagccgaagacaacaccgacagaggctgtgtgagcggaaggattatgctcagtggctacaactataccgttagataattgcgttacttcggccttgggggttgctacagctgtagccaaagacctcttgaactggttagatacagtctttgaagttactgttcttagcattttttttgtttatatatcttgtgttttctttctcagtgatatggtgacgatgatgttcttctcgtattattactccacaattgtcttgatcagcaatggtagcaatttaatattaggattcgttacctatacgaacagggatgatataatattttttctgtgaaagctattgctttattatacgctgttttcctcgaataagacggggaaagagagtaggggaatatcggttagggagcgctgtaggcctttaattttcttgtttggtttttatttggtgcagctgacagcgcgggcccttgaacttctggaggacaaaaaacactgttaatttattggcatttcattggtgcagaaagcgtgctgtccgggtcacagttaaagttcatatacatgttaccctacccagtccgggttatgtaaatcgtgaaaaagaatatctggttttaaaatctctcttttctttttccccctggtgggtatgggtgaaatgctagagaggcaaaaaaaaaggttgccaagtaaagcgaagtatttgaagtatactgcaagcatcaccgaaacaggaaatcacgaagctgactcatctgtgattttccgtccccaccatagtgatgtaacatgcagtaacgcacggcgggccgaaagtcggactttaccccagatttgtagttgtatcctattggatcacgggcgacggacaagacccgaagtgcggaccggcatggtcagcttgcacggaagctttaagggtttcccttgtttcggcattagaagaggcatttcgcacgttttaccgggtcagaaacttcgaggaagctgtgacaattggaaaaaaaggcaaaactaaatgcaatgtatccggttgcccatgcattatttgtgatgttttcggatgtagttcgctgcgctccgcggcgatatatcctctagcgagaggcatatgtataaatatatatatatatatctaacaaaagcattcaagtttctttctctggtgttacgtctttgttcgactttctctgcttacagccctgtatgaccaaagaaaaaataaaaagacagctacataccagcagaaattttttatagtattacactatacatccaagttttttcacaattatttattgtttttctcacatagaaaattccgcatactgcgattataatgaactctacaaccccatcgattcaagatcaatatattttggccagcaaagtacgctccaagctggcaaaatgcgttagcgtgactactaaaaacaaagactacaacctgagagttttagtcgggcacgcaaacttgctggataagattacagaaaatgtggaaactcataatgctgcaaccaacgcccttgccggagaccctttcagtaaaggacctgaaaacttgtccatcgaacatatcgaattgtccaatgctaatgctagtaaaaatgacgtcggtaaggaggaaaatgcagaaaagacgatagaaagtgaagattactgtgatttttactctagtgacgaagatccagatgctgacactctatcttctactgacagtgaagacgatgatgattatgaagactatgattttgagtacgattactctggcggtgattataacaagaaaattgacatgtactttagttttcacaccgcacctaattatcaatatttgactcacacaaactctcattccgagcagacggatgaacttgccgaatcaacgccgcgctacaatgctcttcccgccactgcctctacgacagaggaagaacaggacactgaaacgctcgatgctgtgagtttgcatagttcagcgccaatcttccgtgtgctctctcggcgggtaaatggacaagaagatgacagcgaaaacgagagtagtagcgatgtcgacgatggttccgtaccattaacgagatttcattcttgtcctatcacagcataaattaaaatgaaggaaataacacaacttcgttttgcattatcatattcacatctgcatcctattttttttttctcattgttgttgtatcattattactaactagtgcatcaccacttgtctaaataccaaacgcaaaatatatatattcttacttcataacgttcaaaataaagtttttagtttaaaataaaataaaataaaaaaaaaaaaaaaaaaaaaaaagaaccttttgttttcgcccagtatatgggtaaattaacggttccttttattagtcattttcaactctataccatgctccaaaacggcgttcggcacaggttttttattttaccacgataactcaatatgtacaagattattgcataggcgaaaagtaaagttttaatatggtactttgcgcaataaaactacgaattcaaacgtaaaataagactacagagactaaggtaagacctgttctgctcagataagtggcgttgtccaagtatcagttctacgggaacgtaagaaaaaattttgcgtgagctctcttgagaaccaaaccttcttttttttttttacgaaatgctatttcgttgcagtgagaaggattttttgaaaacagaaatgagttaggccaggctgctcgtactcgcttaaattaggagtgcgagactgaagacctatggtaaacaagactttttttaactaatcaagcatgcgtaatgttatttttacaaaataaaggttacaatttgagattatgcagaagcatatgtctatatgtatgcaacaaatatgatgaggcctatgcagattataagtaaattatttttttttttttttggctttgacattatcatgataaggtgctacttgcgttgttaacaattgtgtttagatatatcgtatcttttcatagccagtggaaacgccgccatattcttcaaaagcttctctttcagttccgaattcttctacttcgacccactcttcgagccatttacggtcagttatcttggcatcgcctggaatacccttaattgggtaaaaatacactaaaatgcagtaactcaatgctgcaaggagataaccaacgaaatagtttaggtagtaaactttcatagcgccaataggcacagaaactcccactgaacctaaaaagcctgcaaaattaggagcaataccaaatatataagctaccaccgccctccagttcgtaccatatttattgtacatgtagtacgatcctggcttgtcggtgtagcaatggaaaatattaacgtaaccctttctgacaatgaagtaatcggctgatattacacccgcaatagcacttaagaaaactgcatatgccgctagtgccgtagtaaactttgacgatgatgataataaatcccaggggcaaatcgccaacgatattagagcacaaatataagaaccgcgtctgatattgatgaatttaggcaataatgcagtcagatcggtacctgcagggatcgagttaccagacaagttggcacccagctggtcaaacgcaaaaatgaaagatattaagaatacaccggctctgttccccgaagtatagttatccaagtacctgttcagaatgtctaggggactccaataatttactccgtacaatgtataagctgcggagacagacaatattccgattaaggaaataatggcatagcagacgggtagcgcaatcaattgcgagtaaacagatgacttgtaggtcttaccgaatctagtgaagtcaggagcgtttaggattaaagtagagaagttatccagagcactcataatagctctaatgacagaccatgctaaaaccgtcttgctgattgcgccaccattgtcatttagggaacccaatgccaaatgacctttggccttacaaagagtccaaatcaaaaaaccgaaggccgcaaatggagtgatggcggatttgagtgcaaatatatgacgcaatttgtcaggtggaaaccataggaacggtaaacatgcgacccagaagaccatgaagcacatgaactcgaagttcgtcaaattggggttctttatggtgtctttgattctagtattcaaattagtaccgaagatagcctttagcatcaactgaacacattgactaccgatataagccaaagtagaattccagacacatgccatgacgacacggttgatgacaatccagatggagaagtagataccaaatgatactcttgaggaaatggggaaagagatatggtaattgttccccactttggaacccagtatcaagaaaaatgcgacaaacgtgtatccaacccaaatacagatccaagtctgccaccagttaagccctaactgtagcccagtggctgagatttgccatgtattgacgttaaaggacccagaaatccaaaagaaaatgtactgcttccatgtccacgttcttctttttgcctccacgggccgcagatctgtgttgtacaagtacgtcgaacggagggactcctgtaaatctttaaatgtcctaattggattttcgggcttatgatcggccaaatcggtagagtcattcttaacctcaaaaaactcgacaactctttgcagccaagacaccttttcgtcatcctgagcaatggttatattgttttctgaatcggtatcttttttttcaatgacattagcatcaatcttagaagtaattttagtcgcatcacccatctcggactctttcgtgatttcttcgtaatcctccgtcggtatagtgtcgtccttcattgtttttgaagaattatcgaatccagaatcagataccggcattttctcttatatagaattaatgaatgagaggactagttaccgccttttatttccgcaatgtgctgcaaagtaaagcaaagctgtccaatactatgttttaaattttacaagaaggtcgaagcaatactactgttatataaaagataggatagcatgtcatcgagtaattgagcaagagaggaaatgaaaaacttttccgttggagaattgatcaaaaattttcaaaaatacgacatgtccctgtgttgtccaggctgacacaatagtttcagtagcgagaaccgccaagttttattgcagcatcctttaatggcaaagatggcgcgataaggacgaaaccggcaaatcccgagcatcaaccacagtgaacgccgcggagaaactcaaaggcgaaaggggagaaaaaaagaaattaatggcacataccgctttgtggcatggctcaatcacatttctttttcttctttctgatcgcccgcaggagaggcagcgccgtttgtgtcccatcgcaaggacaaactagctaggacatgagacttctaagccgttcagtcgaaagagttagggcattagtctctaaagataagtgtgggggcttggttgagtcttgatttaaaagcttggagtaggcattttacgatctattttctctcgaaataaagtaaaggtattgctgcaaaggaattgccgtaatatttaaaacttcttgcttaagtgatgtaaaggcagtgaggcgatagcaatgtttcgtagagcctgtgactagtgaagcataggcaataaattgttttttttttctgattttgtattgccgtctctgcgtcgcagagatttggtgttcgtacggagcgataattgtttttatcttttccaacttaaaggatcgaggaaactcaaagggtggcaaaaacaagcggtataatacaaggtgaactgagttggaaagagagtagccaagactattgaactataaagttaaacaaaatatggccactattgcatcagaatactcttcggaggcgtcaaatacacccattgaacatcaattcaatccttacggtgataatggtggtacaatcctgggcattgcaggtgaagatttcgcagtgttagcaggcgatacaagaaatatcaccgattactcaattaattctcgttatgaacccaaggtttttgattgtggtgataacatagtcatgtcggcgaatggatttgcagcagacggcgacgctttagtaaaaagattcaaaaatagtgtaaaatggtaccatttcgaccacaacgacaaaaaactatctataaactctgcagcaaggaacattcaacatcttctgtacgggaagaggtttttcccttactacgttcatacgatcattgcgggtcttgacgaagatggtaagggcgctgtctattcgttcgacccagttggctcctacgaaagagaacagtgtagagcaggtggtgctgcggcatcattgatcatgccatttttggacaatcaggttaatttcaaaaatcaatatgagccaggtacaaacggtaaagtcaaaaagcctttgaaatacttgtccgtggaagaagtcatcaaactggtgagagactcgttcacttctgctacagaaagacatatacaagtgggtgatgggctggaaatccttattgtcaccaaggatggtgtaaggaaagaattttatgagctaaaaagagattaatgcatacatatcatagtataaaaagaaatagaccaatatcaacatcaattttatgtattttttttttcttttggtatagcattgatatattgaaatttgtatatattgctgcgaacactatttaaaacaggttttttttttattttggcagtttgaaaccctttcctctgatgactttagtgtagtaaatgtaaaagaaatcagagtacaacagagtttgcaaaagtcccgcgaagaaggcaatcttgtccaattttttatcttccgtgctgtacctccaaatccagttaggaatatacaatgctctgtataatcccatggcaaaaatataatgaacagttagacttctagtcttcccacccttagatagcatgtacaattgaggtagaatagccacactctccaaccatacagaaaaactccatgctaattcaagaaaagtgaacttgtgatggaaaaaaacactcattagagcactcccaattagtaaatgctggatcttaaaggtatcatgcataagcatttcattatacgcaatggtgttggttcttttagacccttgtaatagcactacaatgtaagcggtagatacaatgaaaaatattttcattagagcattgtatagggatacccagtgaaaagtcaagagatccaagtatcgtgttatgaaaaccaaagcgtacaacgtttgggtcttgaaagaaataccttcaatgtaccttgtggtcttgatattatgaatcaggatcagtatactggttagatgtgataaatcacctgtcttgatggtcgggaaaaagccctttctctgttagtaagattgggttcgatctacggcgggaaaagcctcatgaaactccaaatagtaacatacctaagattctaaacggattcattgcttactgattatgcctcaacttgcgcgtatatctcactcttgaacaagtgccctcagcaaattcatctgcctcgaaatttgaacttatttttaacgtgttcaatatttagctaaaacgtcgttttcagtccgggtaccgcagataagccatcccggatctttaaaggaaaacgaggaattcagtggtgcagactacactttaatctcaattgaccaaagtgagtcctcaagtaagacgaatattatttttctttcacgactcaattgaattcctaataacacttttgtttgctgtattagcttttagctttgagagcgatgaagcaagagagaaaaataagggtagaaaaaaaaattagaaattgaggaggggaaggtattctaacctggtgaattcccagatacataagtataagaatttctcggcagagattatatacaataaagaataaggttcagttggacgattgcgatagtagcgtgaataacaatttactttaatcaatcgttaggatacttctaatgggcttttttaacaataatccggtaattgaattcttccacagaataacgagaaaacccagtaccattgcgatgtgggtgtttgctggtctgatttgttcaagtacattttatttaatgttcatgtcatcacctacaatcgacttcaactcgaagagtaagaaaaaaaatgataaataatctccctgttcagtactttggtaaaagcacgccatggaaaattatttagaacttccttatacaaaactaaatatttgagcatattctatattcatacatagatacattctttgaatttcaagactcttatttctcattttgaaagccaagattggaggaaaaatcgtaaatttttatccagtcagtaacaactgttggccagtcgaaaactctatcgaaacagcttctatatgtcagataagatagatttattaaattaaatatattcaggagaggaaagacaacatgaacgaaaaaaaaaaaacagtgtagagaagcactacaaatattttctcttccaaaaaatataatatacataaaaaaattagaaatttatctttgttaatgcagtagacttttaattctaaaattttgatttaaaagttgaatttgttttcgccggcctcaagatcgtacttaccttcaatgacatcttgaaggataccagcggaagcagcaactaaacccaaaaatggtttggatggatctaagacctttgatgtgtattctgggtgatattgagtagcaatatagtatgggtgattctttaattccaaaatctcacaacgctttccagtgtcgtccttacctacaaagatcaacccgttgttttccaattcatcaaccatctttggattgatttcgtaacggtgacggtgtctttcatggacttcggagacgtcaccgtataacttcttgatttgactccattcagtttcattttggaaaaatgttggtctcaaacctaatctcattgagccccccatggtttccttgtcaatttcaggcatgaaaacgacaacgtgatttttttcatcaatgtctggataaaattctgccgaatgactgtcttttcttcccaacacactacgtgtaaattcaatggtggcaatttgtaaacccaggcaaacccctaagaatggaatgtgattttcacgagcccatctagcagccaaaaccataccttcagtacctctaacaccaaaaccaccggggattaagataccgtctgcggtactgaccatgttccatgcttcatgaaatttagttttgttgctttcttgtgcttcaggttccaaatcagtagcttccacccatttaatgtctaacttacgacgacacttcatggatgaatgttccaatgcttttatcactgatagataagaatctttcaagttggtgtatttcccaaccaaagcaatcttcactgtttccatggattcatcgaagttacctgttgtggccttccatttagacaataattccaggcctctttgtttttcttcttctgtaagtgatatttcatctaactttaatctggcgtgtaagtaatcaatcatcttttgttccagtagcaacaatgggacgtgataagtagaattaacatcgtgaacgttaaccacctgttcaggccccacatgacaaaacatggcaatcttatcgattgttggtttatccaaagtttcactacatctacaggcgatcatatctggaactaaaccaagagacctcaaacctttgatggcagcttgagttggcttagttttttgttcaccgtggatgacaggaactagagaaacgtgtatcaaggcaaaattttcctttccaactttaaattggaattgtcttagtgcctccacaaaaggagcactttcaatgtcaccaactgtcccacccaattcaatgatacaaacatctggttccataccggtgtcatctacaggaattttggccacgcgctcaatccaatcttggatagcgttggtcaaatgagggacaatttgcacggttttgcctaaatagtcaccttttctttccttagcaataacgtgcgagtatattttaccagtagtaatgttatgatctttagtcaaagtaactccaaggtatctctcgtagttacccaagtccaaatctgtttcaccaccgtcgtcaagcacgaaacattcaccatgttccaaaggagacatagtacctgcatcaatgttcatataagggtcaattttaattgacgtaacctttaaaccgagggttttcattagcataccagttgaagatgcaagaacacctttaccgatacccgaaatgacaccacctgaaacaacaacgtacttcattttctgtctataagtttcttttgttctattgaccaattcactgagaaactgcctgaaactttttcgaccttagaatggcagaaaaatggcaaatactgtaaaatacttaacatttaactaaattttattctatgcttttcctctcgatgagatgagctgtgaaaaattttgaaaaaaaaaaaaaaaaaaaaaaaaaaaaaaatttgttatcaccaataacgagaaacctaactctaaaacttagggtcaaagaacagaaccctaggctttgtatccagttgaatcactaattacgaaagaatgctggtggaaataataatatcatattggtgctcaaataacaagaagacttctttggaagaaattattaccaattaacagtccacttgtagagcgtacatattgccgggaagttgattacctttcaccagaggtacagaggaatagaattttgcaacatgttcccctatttaacaagaatgaatttatccataaagatgggagggctaactttaaaagaaagttcccccaatgcttttttaaataacaccactattgctaggagattcaagcatgaatatgccccacgtttcaaaatcgtacagaaaaagcaaaaaggtagagtgccagttcgtacaggtggttcaataaagggatccactttgcaatttggtaagtacggattacgactgaaaagcgaaggtattaggatatccgcgcaacagctgaaggaagcagataacgcaattatgagatatgtcaggcctttaaacaatggtcatttgtggaggcgtttgtgtacaaacgttgctgtatgtatcaagggtaacgaaacaagaatgggtaaaggtaaaggtgggtttgaccactggatggtgagggtacccacagggaagatccttttcgaaataaatggtgatgatttgcatgaaaaagtcgcacgggaagccttcagaaaagcaggcaccaagttacctggggtatatgaatttgtatccttggattctctggttagagttggattacatagtttcaaaaatcctaaagacgacccagtgaagaatttttacgatgaaaatgcaaagaagccatcaaagaagtatttgaatattttaaagtctcaagaaccacagtacaaactcttcagaggacgttgaacggattgaacacaccatgtatacatgtatataactattgaaaaatatcgatattcacaatcaagtaatctagccatggctatgagtttattaattctagtatgcactgtatactctctgcggaagaataggagtttttccccggagtgagcgctgaagaaacacatgacgacgtgaaaaaacacttgtttgatccagctgaggtataaacactgagaaatatttgagggtcaaagaagcactaggaacgttacagttggaatttgctagtcaatcgagtttccaatttcgcaacctttattatagtactaatcttataagccatggatcgcaaaaaaacacttataaactcaagtgtttctaataataacagtaccatcaagggcctacagttattcattgcagatcttcgttctgcacaacaagcacaagagcaggaaaagagaatacaatctgaaattgtcaaaattaaacagcatttcgatgctgcaaagaaaaaacaaggcaatcacgacagattaggtggctatcaaagaaagaagtacgttgccaagctagcctatatatatattacttctaatacgacaaaactaaatgaaattttattcgggttggagcaaacggtagagctgttgaagtccagcatattttctgaaaaattcattggatatatgacccttgagttgctttatgaacgtagtgaagttgttgccaaagttaacgatgaggtgaattatcaactgatgaaagatctctcttcttccgatgataatttcgtaatgttggcgctgaattttgttggtgtagtaggagaacttacgaaccgtctagcgtacaacgatgatatcacaacaggagtattcaagatattaagatcaccgacctcctccatttatctcaagaaaaaatcagcattgtcatttctagcactattgaaaagtaatcattctatactgaccgaagatttacaacgtaagcaactatggatacaaaggatattaagcttattggatgatacggaaaactataggttaactttagctacgattccgttaatagaattcattgcaaaatacattgatcccagttactgtacgagactattaccacagctaacagaaattttgtacaattgtgttgttgttggtacttcaagatctagtgacaatcagtttccgttagaatatacgttcgcgaatatgccaaatccttggcttatcacaaaagttgtctctttgttgagcatattgattgcctcaccaactgagagggattctggctcattactacaaaccaacaacatagataatgaattactaaataaacttcgaaagtgtgtttccgttgccatcgaattaggaaccagacaagctcaagatcccatggaacgtatcgtccaaaacacagtattgttttcattgatcaatttcgcctctaagctagatccgtcggatgaagctatcagcaattctgtgacagccttatgttccctgctaacatctaaggaaattaatattcggtatttaacgctagattcattggtcaaattatgctcatcaagcgggaaacctgcaattgatgccgttcgttacaagaatttggatatgatttttcatcttttgaacacagaaagagattcatctattgttaggaaggttgttgacttgttatatacctttactgatgttgaaaacgttaagattattgtggacggtttactgcagtatattttatctccgaaaaatcttgctgaaccgcaaataaaatctgatattgcagttaaaatagctattttgaccgagaaatatgccacggatatcaattggtttgtaattatttcgttgcagttgctatcattaacttcaaatacaactattaacgatgatgagatctggcaacgactatgtcaaattgtagtgaacaatccatctttacatagaataacatgtgaacggttggtggactatttatgtaaaaagcaagcatctgaagctattattaaagctgcggcttttctactaggggagtactcaagtctcataacagacaggatttcaagcgcaaatttatttactttgtttgccgagaaatattttagtgcaccaaatgtggctaaggcgatgatattgactacgatgatcaagttgtacaagacctcacctgagatcggctccaacgtcatcaaatttttccaattggaattgaactctcttgatattgagttgcaaacaagatccttcgaatatctcaacattattcaactggctaaggtgaacggaaatacagatattttgcaaattttatttgaaccaatgccgccttttaacagcaaatctaatccattattgaagagattagggtcactgccggcatcagcgggtagcacaactttaataaatacaccatccgaagcatcctcctccacgcctgacttactatcaaaaagagcaaactcttccaggtcgatcatggttcccatgcccccaccatctcgtaggaacaccattgatgatgtaaattccaaaattagttcatctgaagacttttcaggaaaggactcttattattcaaggcagatcctcgctccaaattggagggaaggtttcacaagaatgatttcgcataagcagggtgtgcttttcacatcatctttgatgaaagttttctatcggataaccactcctgatgcacaacagccatacgtgtttcatatatctcttgccttcattaacctgactgagtgggaaatcacgggattatccacacagattatcccttcaaaaacgcaaggtaatcctgagtatttaattatgaatattaatacaccttctactgctactattgggccccataaaagggcagagcaaagctatgaagtttcaataagaaaacctttcgacgttgaagatagtccaattttggcaattcatttcaaatgtggcggtagtacaaacactatcaatttgaaaactgccataggcatgactacaacactaattagcagcgatgtcaatcctagcatgcatttgaatttggcacagttcatcagccgttggaagactttgagcgatgctttgggaaaagagggagaataccaaaaatctggcataaagctcaacaaggattttagaaaagttgaaacaatcagtttagaagacggacttctactattgacgcaaacagtgaagaggttgggctttgatatagtcgatcagaccagtgttcgtagtacattgtttgtctcgggtattattcatacgaaaagtgagggaaacttcggttgtttaatgaagatacaataccaggtaaatggaacagttaatgttacctgtaaaacaacgacggccggtcccctggcgaagtacattgtcgaatgtataaagaatgtgcttacgaagtaaaattttctcaaattcactataatgaaaatcatccgcattgtacatatataaacacacacacacatatatatatatatttgagattctatttattttcattttgtgttgtaatgctataaaaaaaaagatcttcgtataaaatctcagttcattcaacctactaaatgattctagcttcattttttggaggtctagcaccaaaaatgtcggtaccaattctgacttccgctgttccttgccttatagcctccctgaaatcagcactcatccccatagacaatttcaatgatgtaccaaatttagcatcaatcttcttcttccactcaaccagcgtagcaaagtctctgttttctttgctatcttcatgagagacgttccatgaaccaatagtcattaacccattcaacttaatatacttgcattcttcggataagaagaagtcgatgacttcaaatatttctgcttcattattcaagcccgatttttgatcctcatgggaggtattaatttgaacattacacaatattgggttgcaatctggttgaaatttagccctcgattcgtttaattttttggctttcttcaaggagtcgattgtttcaacagagtataaatttggcactttagccaaatctttacatttattcgtttgcaaaccgccaataaagtgccacttgatatcgtctggtagtaattttgccttttcgatcaactcttgaacatagttttccccgaactccctcacaccatggtcgtaaagaatttgtatatcgctagctggtttcaatttcgaaacaaccaataataaaattttggaggcattttcattaacatgaacattttttgcctctgcattcacaacttcccttacagattcgtattgggcaattaattgtgtctttctatcttcatcataagtaataccagtggacatattgcaatgtgatgctggaatcttagtcaaaaaggaaagagtgatgcctatcagtttttttttttattatgcatttaagagtagtctctacttatgaacattttctctggcctctgatcacgttactttattacccggatactgatcatgttatggtctttaatcaataagtaagttatagagccagtttcaaggtcgatagttcaggtgtataacaatactttttggtgctaccttgagctattccattagttaagtttgaattaaatatatcaactagcaatcaagtcaactctagcgcgcttccacacgttgtgtagataaactggctcttcaccttcaacaagcgtcaatttcccgtcttcaagatcagggcattggacagtaatttgtgcataggatcccctgttacctgttgctctaataaatcttccgggatttataacaactacgttttggacaactcttgcaaagtgttgtaattcactgggtataatcattatgtcaggcgagaacccaccaacaaactctgttagtcccagataactcacgtctaaatctgcaccagatatatgttcataaactttttcttctttgctttccatatcattggtttccttcttcgtagatacgtcttttggttttattcttgtacgaatactacctggaaatatggggtaatacctgcgctgttgtaaaatatgctcagaaacacgatctaatctatatcttgatgaggtagtaccgccttttatgacttcctttagatctttgaatgtatcaacgtttgagcaaccgaagtatatctcatttatttgaaaagatgaaggattagccatgcatttgaagttccttttaggcagctgtaaagcctttctaattaaagaagcttgtggatatgcggcgtgattagaaattgcatcttttgtggagggtatcaatacggtttggatatgtggtgatatggtttttagaataggagtaaataacttcaaaaaaagctcgtccaatgttttgggctgtgtcttgaactggggaaaatttggcaatttaccactcgctatcagaggatgggtgatatctataaatgggccaaacattatcaagacgtgaggttttacctcattatttatactatcgataaattcttgcaacaattcgagggagaagttatcatttgcaaagtatgggccacaggtcacgataaccttcaaagaagaaccttccaaatttgcttgaaactcctgcagttcctgcgatgtggacactggggagtttggataaggtagcggcaaaatagagttaacggtgaagtaatccccattagcatttttacctttgaatgccacaatttggcctaagaaaaacgaaagctcgttgacctgcgatagatctaaccttacccttcttccaacgccgcccattcttgaggtctctagggaaagcgattctggattcaaaaacttgtcgtaggtcggcgaatctggaactatccttccaacagcataaatttcggactgagattgaatagttggatcagcgaagtcgtttggagataacttatagtgattttgaataatcttagtaaacgattcaatttgatcatcgaggacatcagacgcttcctgtaagttttgcctcattgttctgaatttatactttttagcatcataaaatggttctactttgacctggttatatgatggttcttcagtcgaaagaaggcctacatttggattaccagatgatatttcaatattttcagggttcaaagaatccaaaatttcaccagcaggaacattttgcctcgatgtggtaggagtgtttgttgttggagtttggaatgtcgacgagccgggagtcttggcatccgagcttttagcgtgggacaatggagcactgtcacccacagcatcttctgccatgcctggagtaaactccaattttaaagaactatttcctttttcatttgtttctgcctcagagcctacattatatgtttgcttggaatcactgagtgaaaagggaccatgtaactttcttttttttaaagtcggagtctttggaatactaaggccaaacaagggacttgaattcaaactttttttaatcactggtttttttgtggatgtgtttaccttagaggacgatgaaatttggttagcacgcttttccatttgtaattgtaaaaattgtttaaactcatctatgttcttggaagtcagatctgtgtgagtttgacgcctttgattggagaactgctcccatttaatgtatagatcctcgacggacaatgcatgcagtttagttaaattctctaatgcagtgatgatttccggcttgtctgcatcaggcccaaaatgagtgatgacatcgatagatccgctcatttttttttttttcagtcacttgctcctgcctaaatttaccttcaagctttgttgaaccaattgacaatcaattatcttgatatttttatatgcaaatatattatgtatatgaaacaaaatgttatatgtgtctacaaagagctcatattattacagttttagaaaagagaaagaactaagaaactctggtgagacgcgtcacggtaaaaaaaaattacgcgtctaccacgctattctctattcgtttgaggcgatgaacatgatcattttaaagacattcttaggcaaacaatcgaataatcgttcggtttcttgctcagtataatctggagtagtttggaggactctcaaacaacgagctaataccacggcactggtgaagttccacgaagtattatcagtccccataatgaaatagctcattgtttggataatctctgatatattagatttcttgaattgttggcaaatggtaggagattgcagcatcttccataaggtctcaattaaaaatgtttctttcacaccagcggtgtcaggctgaatttcagtaaccaacatgcttagaattcttgttgccgaatgttttttgaaaaagtgcgataacattagactgtccctgaactcttgcgctaatttatagatttcgtttccataatcagaaaatttattaagcattaaaaggatctgttcccatacttcttcgaaacacattctcaccgaaacgccatcatcgtcggcattctcgcttagtgtatttagaaactttttccaaaccaaaagacaatgaacgagaattatggacttactggatatttttgatggaattgaaggcgtgtcatcagtagatttcaaaagcataatagcaacatccagtagttcatcaaaaccattttcattcgtcaaccaatcggtcattttttgattttgaaaacaagtaatcaagggttcgatcaggtaatttatatgtttcatagtgaacgatccactttttatcctgtttattgcctttgacatgtgattgaaatagacatcaaaatccatcaaagtgttgccattagaatcaaccattaaaagatgactaatttcatatacagtcaaggaatcccttgggaaattatccatgataagcaaatgcatcttctctgattttttgttattaactagtttcatctttttggagtttatgtcttgttcagttagtgctacgtctctttctctctttactgtgatcctttgcttttgacccatattctcgtccccgtttattttgattggtgacattgtttccaaatcaggcttttcattctcattcccatttccaataagtttttctggctcatttattatctttggaggatctgtactgaattttactgttggttcattatcgtccttcaatttcctttcggtattttcaccactgttttgaaaaatttcacttaaattcaaatcagatttttgagaattttccatatctatatcatcttcctcctttgctgggtttggctggtccagttgataaacacttactattttcgtcatttctgaaagctttttatctttgtcattatcatcatgaataactacgctgtctgtgcttgatgttctttttccaacgttattcttcaactctagtgttttatcagtttccaagtttttgaagggattaatcattgtcatttccatgcatttcttaacatcattttcgtctacagcatcgtcggattcctcatccccttcagattttttattgtcgatgggagtgaagcttacagaactttctctagaaatgatgtcttctaccttaaagttggcatccttcttttcaagttcatgacagattttcatcttggtagatacaatgtcaaaatcagctagcaatttattaaaacgattattatcgaatttataaatttcaaaaattagattgaaataacatgtgtagtcaaactctttaccgtagatttgaaagagtatcattgatattttaggcatgagatcgttcgttcctgacctcagagtgttatcatgttttatgttcaagttacggaaaatctctaaaagtaacttgaaattataattgaaaaaagtggttttgtatttcatatagtatagtttgaaatcattcggacaattattggcattcaagaaattgaataaatccgcgatagttataatcaagttagtaagctcgtagggcttttcaggattcattctattctttaagatttccgcgtaatcaaaactattaatagaatatagctcaatgaggtaatttaagggaactccatttgtaaacttctctatactcaaaaatggcttgaaatcatttggtgactttatcataatttggcgtagctttttcataatcatgggaaattcaaattttggggctgatgatgactgttgcgatgtcaacagtaactccttttgtaaatactgtaaagcatctttgatctgagctggaaacgaagcatcattgaattttttgtaaagggtttcatattcaccaagtttattactgccttttaatgagattggagaagatgacatcgaaacatcatttttatccatatatttctttatcaacgggttagagtaactatttgataactcatcagtcaagtcgatttggtttgacggaaagtcatcaaaatttgtgtaattttcagatacttttgtggcggcagtagaagaaggaggggcactaacttttcttttagtaacattattattatctttggtgttgctgtttgaaacagagttcatactgtcatgatgccttgcccttttttcattttctttacttgaatattcactagtagaccttaagtttgttttcagcttatttgatagtttactggctatgacacttccaccagctgtgactgcaggagcgttgagtagggaggtggaggaagattgagtcggttgggcataacttggatagttccttttctgctccagtaaactggtttttcttgaagaattattcgaagagtgagagtacaatcgagacgttgcagaggaggcggaggcagtagaggacaccctggaaacttgatagtttatattcaaatgagcagggattgccaattctgttgcttttttcaactgtggagaaaaggaagaactcaataatcttttggcatttgtaggataacatttgtagaaataccaaaaagttaacctcattgcctctctaacggttgtctgtgaatctgaaatgcccttttttagccattcttcgatgtatatgatgttattctccaactttgaggttggcgaagttgtatttgaattgttgagcgaaagattggagtcgttgaacttaatcaggaagctacgcagcagtattgcagagcaaaatctcggtgttacggttttctcatttattaataaaaaagataattggaatagtttattatggaaatgatttatatcaatgatcaaagtaattaaacaatgaaatgcagtttgtgaagagattttcttggtagatgataacaagttcttgaaaatgacaaatatttggtccaatattgataggggcaactgatcgtttaggatatggattagcctcttgaggaaaagtaatgcagttaatgataacgttgtcctcaacgacgaggtagctcttgaaatcaactcaatcaactgcacctcctttattacagtgacaaattcctctggattatctttgggaatgttgccggatataatgttgtctaattcaattatatttgattgccttagcttccaattttgttctgtttcctttacactttggaacggtgccaacaaattctccaagtcttgttgtaattggttcaaagactcatagttttttttcatcgctgggtctttactgctcaagttgtttgataactgcggcaatttcgcttcggctaatagtaattgaaactcgtactcttcgtcaaacaaggtcgatttatcttcttgtgaaccatgctggtcctgtgactttgctaaacttatgaatttttgcttgaatttctcaacttctaaatcgttaataaatccatctatcagatcctgtgaattttcgtcatccattttcaaatacttgtacattatatcgaaaataagctctattattacattattgttatcatcgtttgcgtgttcatttaggttgttatttaaaaggttggtgaaagacagcatgaaaaacctcagtagttgcaaatgatttgaattatttttctcgttgatctggatcaactcatcgatggtcaataatgtagattttatcctattcaggtaatctccgttttggttttcacttggtcttcgcaagaaatttgctagaatagcttggatcttcgatggattaaccaaataaatggcttcaatggctttaatggaagccagccaaaatttcttctcattaggcaactcgaaaattaagtggtttagtaattgctcaactagagtgtcattgaattgtactggagactgcatggccacacgtttgataaggtaacaaagcgaggaatgtgataggaagattaaccgcgggtacgaacggtaagcgtaatggccggagatgaacagtaacgcagcgaaataagcttggatcgacgattcgttaactagttccttttttacatgtcctttgaaccgtgtaagcagtgccattttttcctcgatgggtacagactcgtccttgaatacggtatacaaagggaaggaatcgtctggatgtgtattagtgttgctgttattattggtctcattgttgaaggacgacattatttctgaagaatacaaggtctctccaaaaaccctaataattaccgctaaatatgcctgtcaatcggatgaagggaagtttcaacctcaaatgtaaataaatagatgtttagcgttttagaataaataagtaaataatttgattttctataaagatgttaatgcgccaatacgcgccgacggggtaacgcattaaaataacatggtattttcgtttcattacaaaaaaagcactatatgtactaataattatgctacacttgtgtttatattgccagcgtcgatgttgatgacaacgcagagttcatacggttttggttttgggcttcacttgtctcagtaggttgagggtttgtatgaagtttcagaggctccgttagtaaatgacccattctttctatcttggtcctgagataaccttctatctccttggagtctatgccttcactggagtttgtccagtgtatgggtaccataggcactcgttcaacgcacttaaggtaaggcgcatgatctacctgttttatcttttccgggttatttgtcagcagcctgacattaccgatgccaagatccagcaaaatagccttacccagcgagaagtccctagcatccacgggatgtttcagcattaagttggcctgcactgtgtcagcacctaagtcttgcaggttgtaggccttgagtttctcacctaacccgatgccacgaccctcttgtcttagatacacgataacaccatggccgtttccacctttgatcttgcttgtgggttcgtggtcgcaagcgataagcctaccggccctatcgaattgttcaccacaatcacaacgggcgctccatgcgttttcaccggtgtaacattcagaatggatccgtaccagcgtgtcgttatgggcgtcccatgtagtggctttggaagctaataactcacctgtactatcatcaaactccagagctaatccgagtctatcgtcttcgtctgccacagttctgccgggatacagtttgccaatataagcgcccctgatcattctatcttgttgcgtctcgcactgtcttctacggaatagcgagcgcgaccgtatgtcttcaccaaacacaatggctagatgttccttgttgtccctgttgttactgtaaagatgtaaaaagatatccggaccctgtgtggttgggatacgagctcttgcgacacattgtactagaggcaagccgccatcgccgttcctgccatcacccgtaccactaacctcgtatttgctgctatcctgtttactgttgtcgtagttatctatggtcatcctgtaggtttgttgtagttttatgtacgccactttttgtaatgactcaattattgtccacgccagcacagcaacttctttatatatactatagcggcgctggcgctcaccccacaagagcgtccgactaatttctgacaaatcgtaaaaagaaaaagaaaaactcaaaggaaaaagaaaaagtctcaccctacacaacttgttttcaaaaacggtatagaccctactatttctgttttagccctatgctaagtctagacattaccctatcccttttaacgaaagcccttttgttttttttctgtgtgtccggccgctcagccaaacaacaaacaagactataatctggagcataagtacccgagcatatataactacttggcatacgaagtaaaagcatattgctccccactcctatcgcgcgtcccctgtacaacaaagcatcaacttatcgggtaacttagagacagcattagtatatataccagccatgtcacagttcttcgaagctgctactcccgttgcaattcccacaaacaataccaacggcggctccagtgatgccggcagcgccgccactggcggcgcccccgttgttggcaccaccgctcaacccaccatcaatcacaggcttttgctgtcattgaaagaggctgccaagatcattggcactaagggctccaccatctcacgcataagagctgcaaacgccgtcaagatcggtatttctgaaaaggtgcccggttgctctgacaggatcctgtcctgtgctgggaacgtaatcaatgtggccaatgccattggtgatattgttgacgtgcttaacaaacggaatcccgaaaatgaggacgcagctgagggcgaagcggaagagcactactacttccactttttgaaccatattttaccagctccctcaaaggacgagatcagagatctgcagcaactggaggacatcggttatgtgaggctcattgtggccaattcccatatctcatcgattatcgggaaagcaggcgccaccatcaagtccctgatcaataagcacggcgttaagatcgtggcttccaaggacttcttacctgctagcgacgagagaattatcgagatccagggtttcccaggatccatcaccaatgtacttatcgaaattagcgagatcatcttgagtgacgttgacgtcagattcagcacagaaagatcttatttccctcatctgaaaaagtcctccggtgagccaacttccccttctacctcatctaacactaggatcgaattgaagattccagaactgtatgtaggcgccattattggccgtggaatgaacagaattaagaatttgaaaactttcacaaaaaccaatattgtcgtggaaaggaaggatgacgatgataaagacgaaaattttagaaaattcataatcacaagtaaatttcctaagaatgtcaaacttgctgagtccatgcttttgaagaacctgaatactgaaattgagaaacgtgaaaactacaagagaaaattggaagctgccgaaggagatgccactgttgttactgaacgctctgattctgcttctttcttggaagagaaggaagaacctcaagagaatcatgataacaaagaggagcagtcgtagtatatacgtgtgcgtgcgcacgtcccacacagacaaaacaaactatcatcttaacgaataatgttgcatcattactagtttaaactgtatttttattaaagggaaaaaaatgattcaatatgtatatatttattcatgtatatgtattttgaattaaaaaaaaacgttttataaatactcaataaagccgttgtattttctttattactatcgaaattcttgctttaaacatttcgcgcatcgccggctagaggcacagagagggaaggggaaaataacatgaaaaaatcgtaagtttctaggcaatggtataaacaaataaacaataaacatgcaattacagctctagaacacatattatcttcatggatgaatgataaactccaagaagagcataacgaaaaagacaccacttcacaaattaatggtttcacgccgccgcatatgagtatagactttcattcaaataacaatagcaatatcatcgagactattggcgtttccaaaagattaggaaattctgtattaagtgaactggattctagagctagctcaaaatttgaatttttaaaagatcaatccgaacaacaatacaacggcgacaagaacaatgaaccaaaatcgggctcgtataatattaatgagttcttccaagcaaagcacgactctcaatttggccagatggagtcgctagacacacattatacccttttacatacgcccaagagaaagtcacaacatgcaatcccacaggatcgatcggattcgatgaaaaggtcgagaccgtcccgctcaattccatacactacaccagtggtaaacgatatcacaagaagaatacgaagattgaaattacggaactcattggttaatggtaatgacatagtggctagagcgagatctatgcaagcaaattctaacattaattcaataaagaacacaccattgtcaaagcccaagccatttatgcacaaaccaaactttctaatgcccactacgaattctttgaacaagatcaattccgctcaccgtaatacatcctcctcttcgacagcttcatcgataccaagatctaaagtacacagatcgatatcaataagagatttacacgccaaaaccaaaccggtagaacgcacgccagttgcgcaaggaacaaattcgcaattgaagaattcagtttccgtttttgatagactttacaagcaaacaacgttctctaggtcgacgtctatgaacaacttatcgtcaggaacctctgcaaaatccaaggaacacacaaatgtaaagactcggttggttaaaagtaagacaagtggttcattgtccagtaaccttaagcaaagtactgccaccggcacaaagagtgatagacctatttggcggtgattaagtaataaaaaaattgcattttataagaaacatcatgtgatgacatttaaaaagtgggaaagaatactactaatataaaactatttactggatatttagaattttttttttttcttctttatacgtaaaagttgttcaaaaaatttcatcgttttctttttttatgaatctttgattcttgttgaaaagaatttctaaaaaaataggaggataataatattatcaaaacaaatcgtgtcactcattaaacaccaaaaatccaaagaagaaaaaaaggaaaatgtgagaaagaatttagattaagaatcaagccagattagacttatttgaacttcttaccaaacaagatcatttgcagttggtcgtacattgagataacaccagcacctgcgacacctcttaagatgttagcaccacaacccttgaatagagaaccaacaccttcagcagcaacaatcttcctcaaacagtcaaaggcaccgtcgtacttaacagcttgaccggaggtcatcatcattcttcttctaacggtatccaatgggtaagaacatgtagaagcaccagtagtaacaacccaacccaacaagaatgaagccaagaatgaaccttccaaagaaccagtcaacaatagaggcttcaaagaatcgtacataccgaagtatagacctctgtagacaacaataccaacgacagaaggtaagaaacctctgtaaagaccagcaacaccatcagattttaaggtcttcttgtagacatcgatcaaaccgttgaattgacgagcaccaccctttttagaggacttggagtcagcagccaatctagttcttgcataatccaaagagtaaacaaatagtaatgacaaggcaccagcagcaccaccagatgccaagttaccggcaaaccatttggcgtaaccttcttccttcttgaaaccaaacatggccttgatcttgtccttgaaggcgaaattcaaagcttgagtggggaaataacggataacgttagcagtgttacctctccagaatgagataacaccttcctgtgtagcggttctcttgaaacagtctaagatacctgcgtattttctgtccaaagtaccttgttttaacatttcatcttggttttggatcaaaagtttaactctttcgatgggagatgcagcagttttggcgacagcggcactgacaccacccattaagaaatcaatcaaaaagttagattccttctttggagctggggctggaggtaatggggttttgacttgggcgttggaagacatggctatttgcttatatgtatgttaatgtatgattctgaagtataaaagagcacacaaaaaagaacaacgacaaatataaataatatagaggggctcctttgacttgtagatgtattgcaatgttccgtataactaacagtgaatatatacttttttgagtgggttgtcgtgaaaaattaatattaaaaactcaaatggtatttatattgtgcgacgacgtgggcccgatcgacggagacatgtccccgataatcgcacctcaccctctgagagtggggccttctcattggcccgcgctctacaccaatcagcatagcgcatttaccgcctttcgcttgttctccattggaaacagtgctcgtgcatcgtgatgttatttgttacgtatggaaaaatcgtgtctatacttctgtataatatatgtatggttatagtgaacacatatatataaatacatatataagaggaagaaaaggaaattatttcgttatcagttgggctgcttttgtcgtaagttttgttgttcttgaatgactttattaagctgttcgtcattcttaaaatcttgtcgccaattgcatatggggcagtgcaactgttttccccagaagaccggaaccaacggtataaaccaaatagtgaaaaattcctttctttttatggggccgacactataattgtgacaattcgggcaatacaggttttgatgtccgggaacggtatcgtatgaagagtcgaaactcttcataccacatacaataggtatgaatgacatggtaattttttctttttgaggttgtgtattaagttgcttatctgatttcactttacaccaatcttccttgctgacatttattcccaacttgttcttcagccgcttgttttataacgtacattattgtaaaaacggagtagaaagggaaaaagggaaagggatggacgtggctaatgcgcatcttcgtttgtgtgtatatcctttgatcttcactacataatttgttacccgacaatgcttttttttttttctcaattttcatctcttttctttttcctcatttcttatgaaaatcagtgtgactaaaatgagacttcgtattttttgtagaggcaccatacgccggctccgccgtcaccacattctcccctgccggtaaagaccggcgcacgcggaaaaggcgtacatagcgtcgggcggtaacggagtcattccatcgctgataattaccccttgcagcaaacccagagccctattacgaatctagcccatacaccgcgttagagcactcgccgttttgctccgggtcgtgccgtcgtacatgcatacgcgtcctgcaggcataccataagcccacatacaatcacctgtagaaagaaacaaagcttgtgtatgtaatcaaagcagaaatctgatgggttcgaacgacttcgttatagaaatattatctttgggtctcgtcctgcgttattcctcctgtctcctgccgctttgataaccttttcattcctccccttaacttgttatttcgtgttacgatattgggtaacttagtagcgtaaatggtaaaatgtagggactcaatctcataggtggttatgtttttcgttctcatttttcaaatctgtgacttcacagacaaaacgcgtagtgatttctttatctgaatgagccttcgaaaaaaaaaacaacgatttcttatgcagttagtcggccagttggttattgactatctgtgcgattccccttcctgcataaaaataaacacaatcttaatacgccatacgttgactccattttttgctcgtttcattatattatcttcccatgccgctcctgcgtgggattccctttattataacttttaaggtttctacccacatatatgcaatttttatcatgtttttctcttttttttttttttttttttttttctctctttgttgtgttttcgagaaaaagttcaattgtttaaaaggaattaagcaaattatatatatgcgactgttggtttccagttctaatctgtactcttttttttgaatttgcactgttatctccttttatacttgcgtgttaatcttgtattaggcaaaagcttagtcgtaatatatagagattataaaaccaaaataaagctaatgtgcgccaatatccccgaattcgactctttttacgaaaatgaaaatataaattacaacttggaatcattcgcacctttaaattgtgatgttaattcgccctttctccccattaataacaatgacatcaacgttaatgcttatggtgacgaaaatttaacgtactccaactttttactgtcttataacgataagctggctactacaactgctaaaaacaatagcattaataatagtaatagtaataataatagtaataataataaaaataataataataatcataataataataatctactcggtaatgacatcagtcagatggcctttttactcgattacccttctactctcaacgaaccgcaatttgccgtaaattgtaaagacatttacagaaaggatatatcaacgccttcgtcattagtttcgagtctgccacctgcaaagttttcgttatccctatcgaattcgccttctccgccaccaccatcgtcgtcctctttgaaacatggggaagcaataatttctaataccagcgaaagcagtgacatatttgccgatcctaattcgtttgaaaaggatactatgcccctaacgcaagaactgacgctagaaaatctaaataatcaattaaactatcccgatttcacgataaacgccatcgagcaggatcctgccccttcgtctttttcatcctcatcttcgtcttcggagtcaacggtctcttccagcaggaagaggaagccctgtcatgattcctacacacattcttcaccctcttcctcagagtctaagaaaatttccgactcgagattatccgccgaaggtttagccaaagtgcttaatttagaatcccccgaagaagctttaaaaagagaacgctttatattgggtattttccagaatgaattaaattacccgctaggttacaaaacgtggattagggatactacaaaagaatataggacaaagttaatcaatcaactgcacgaacgagtaaaggtaaagtaccccgaatacaaccagtccatactggaaacaataattagacgaggcacctactacatgatgcagagtaggttaagaagagagaggagaatgaagcttaaggaacgtaaaagaacaacctaattttattacccaaaaaaaaaaatgcattatatatttcatccatatatagaacacacttactcacataaaagacaaatatataaaagtgaaccggttttcatatcatcaccctctgttgtcctttcaactcttaaattgtctaggaagagataaagcacggtgaagaataaaaataacgtcggaattttagtatggtacataattaaaaattttacaacctagctcctatcaagttcttattaccttcattttatcagaatctggtgaaagaagtttttttcttagattgtttcatcagcttagcctttttataagtgtgatgtctaccgtctctccaaccagaggtgctgattttttttctgggagcttcttcattggattttttctcgtcgacatccatgtcaattccttgctcttctttcttttttagatcttctaatttttgctttagtaagtcttcctttagtttatcggatattctttgttcacgtgcatctactgctttttggaaaacgccacgtcttttgacagatttagcatttagatgactgctagcacgtaatgatttggccatgattcttgttctagtaagttttaacttattttatatgctgaactcttggtttgtcatcagtgtcaatatatcagaatgttttactaatacctagtacgaaaatttttcgtagagcctcatcgctctgtctctcgctatccaaaaaaaaaaaaaaaagtggaactggatgaatattgcgtataaggacagtgttttaaaacccagacatatttttcaccagtacctcttggaaaacggaaaaagtttttttgcgaatactttcaattcttgagttgtaaggctgcatccctccgtagaacaaaccagagagccgagcttagtaatgagcttacggaatgttcgtcccactgggagggagtggcaataccgtctaacctctcgcctacgttctcatcgctatgggaattgggcaggcctggtgggactggcccttctttctacacattccacatcggtagcttgttatactcctcgggagattactgtatctacatcgggatactaatagtacatttatacgctagtgctacttgatagatcttttcaccaaatcgaataaaaagtcaccaataaattagaggaaaatgtatgtttaacagtgatactaaattttgaacctttcacaagatttatctttaaatatgttatgaatgtcatcctttggagagaaatagataaggaaaaaaattgaggatacagcatccggtggtcgcatagttggtagcaacatccatagaagaacctcagataaatttcaagcttgtacgaattgccgcgtttattacaaactatagaattatcgcagcaatggtacgtgtctgttcctgcaagcgttaattcgattgatagataaagtaattcattaacctttgcgaatatgctctttactgttaggtttcaggattttaaaaatgaagcaactttactaacatcaatatgcaaataaatctgcaaaaactttttttcacagggctaacttgcgtactcaaaagagacttgccgcttctgttgtcggtgttggtaagagaaaggtttggttagacccaaacgaaacttctgaaattgcccaagccaactctagaaatgccattagaaaattggtcaagaacggaaccatcgtcaagaaggccgttactgtccactctaaatctagaactagagcccatgctcaatccaagagagaaggtcgtcacagtggttacggtaagagaaagggtactagagaagctcgtttaccatcccaagtcgtctggatcagaagattacgtgtcttgagaagattattggccaagtaccgtgacgctggtaagattgacaagcatttgtaccacgttttgtacaaggaatccaagggtaacgccttcaagcacaagagagctttggttgaacacattattcaagctaaggctgatgctcaacgtgaaaaggctttgaacgaagaagctgaagctagaagattgaagaacagagctgctcgtgacagaagagctcaaagagttgctgaaaagagagacgctttgctaaaggaagacgcttaattgattacaaataattagctaagaaattacgtaccttctcattgttctatatatgttttattttctctaaaatgtaccaaatacaataatagtttcaaaggagcagagaaagaaactaaggtgaaggagactgttcgtagaataaatgaatattgattaaaattttctgaaaaaaagagtaatgaagtcgtagtcatcgctaatgtaccgtaagtgagttctgaaaggaggcgggttcttgtttcaacgtagcttgtctagtcctttatggcatcgtgtaaaattggtatatattcagaacacccaggagtgaattgatttgctgctatagggggaaataagatgtaacgatattttttgtactgaatttctttgatgatactgccaggattgagagtttggttgccacatgtacgcttaggacactcatgactatcactcctgtgtatcgcttccatgtcgtatacccactggccgattctcaccctctgcattgtatgatattactagtattgcttgtttcaggggcaagaattttcactaatacactaccagtttatgatagcttatctacatccttttactgcaaaattattctggatttgcaaaattattctggatttgcaaaagttcggcttcactatcaaagcgaaaggtgacctttttatcgtacctttaagaaagataggcataaacaatactgtgtggcaggaaaagatttgatgaagaccaaaaacagcatcgaagtgctttgctacgatttctttttttactctccggttattttgagctatcttgtcattatatctttaaatttatatatttctttgcccagcttttaagcgttcactggaattgcccatatgttcactaaatataaaactgattattctctcctctatattgtcatctcggcagaaaagctacttttaaataagttttaaacaccagttttctgcaatgataaaaatagctactttggatagaggctgaggcctaactagttggaagaaactacttagggatcctttgtacgggaaacttttttccgctgttgtaattgtatcattgtcgttgttcatttttcaaatccaggcaatgaggaagttttgaaccaaaaaaaataaaaccgaaaacagagcaactttaattatagtacggcatataaggaaaacaaatccagaattcaataaaagaatacaatactttcgaacacatatctcacgctgataacaccctagcaagtatgcttttcttctcctttttcaagactttagttgaccaagaagtggtcgtagaggtatgttcataatgatttacatcggaattccctttgatacaagaaaactaacgggtatcgtacatcaatttttgaaaaaagtcaagtactaacgtttgtttacccctgtttattgtgtttccactcagttaaaaaacgacattgaaataaaaggtacactacaatcagttgaccaatttttgaatctgaaactagacaacatatcatgcacagatgaaaaaaaatatccacacttgggttccgtaaggaatatttttataagaggttcaacagtcaggtacgtttacttgaataagaacatggtagatacgaatttgctacaagacgctaccagaagggaggtaatgactgaaagaaaataagaattatgcagtctatcctcatggcattttttctcattagttttttacacgagtatcattttaggatattgagattatatgtatatgtatatatgtaggccataagatgattcaacggtttgtattaattatccggttccgagcgttaggagaaataacttggtgtgatatctgtcaagtggtcatccaaaatttttttggccagagcgtaagctacgtagactgatgaggaattctttttttttgccccattttatcccaagaaattcattatgaggttttgttttgttttactaaatgcgcttgatggaaaagcgaatgtcatgaaatgcagatcaacactccaataaaaaagtaaatgtttttaaagaagtatatcacgctacaaaaattcataagcactatatttcgaacgttaacctaaatctctcccactaagaaaatggatagaaatgtatatgaagcctgcagcaatataattaaggaatttggaacacatgtagtgagcgccgatgaagtactcgcagaaaaaatagataatgctgttcctataccgttcaaaacaagggaggagatagatgccgacgtggaaaaagatagaaacgaaggagttttcgaaggtaatatcattcctgatatcgacctacgtgtagtacactactacgccacgcagttgtgtctaaataagtatcctcatttgattaacgcctttgatgagacaagccttataacattgggtttactcatcgaaaagtgggtaaaagactatctaaccagcatccagacagaacagggaaggcaaagtaaggtaatcgggaaggggccatgcgaattcatatcaaaacatattgattataggcatgcgccaggtaatatctgaatgtagcaaaaacctggcttttgcggctggggaggatggaaggcttttgtaggctattatctactcgaggaaggaacgttagaatatctccatttttcacgcaaaatgtggttctgagttaatgcgtgtgctgaagcataacatgagttattccctgtatgtatgtacagtatttcaatttcgcagaccgtgggttacatatgtgagcgattaggaagtagtgaagtaattatggcaagtctagaggtccggctgatcccttgcggtgctgaagtaacgaaaccgcgcgcatatcttttggaagagattaatttgcactgaattttcaaacttaattagcgagaagaagtagatgcatttcaattatgccaaaagcagtatttattacttcttatagaatatagtatcacttacgctcatttagtgtacccacttacgtattaaatgacgtactttttttttgtcctcttctgtagctttttttcactttgaaaaatttagcgctgagttcttccaaagacgtcaaatcacctactatagttaaaaacatattacttatactagttctaacacttccttttatctacactgtaatccgaagaatacactataaggatggctagaagaaagaatttcaaaaaagggaacaagaagacttttggtgctcgtgatgactcgagagctcaaaaaaactggtctgaactggtaaaggaaaatgaaaaatgggaaaaatactataagactttagctcttttcccagaagatcaatgggaagaatttaaaaagacatgtcaagctccacttcctctaacttttagaattacaggttctagaaagcatgccggtgaggtcctgaatttgtttaaagaaagacatctaccaaacttgactaatgttgagtttgaaggtgagaagattaaggcccctgtagaattaccttggtatccagaccatcttgcttggcaattggacgttcctaagacggttattagaaagaatgaacaattcgcaaaaactcagagatttttagttgttgaaaatgccgttggtaatatctcaagacaagaagccgtttcaatgattcctccaatcgttctagaagtaaaacctcatcacactgttttagatatgtgtgctgctcctggctccaaaactgctcaattaatcgaagccttgcacaaggatacagatgaaccatctggtttcgttgtagctaatgatgccgatgccagaagatctcatatgttggttcaccaattgaagagattgaacagtgccaacttgatggttgtcaaccatgacgcccaattcttcccacgtatcagattacatggcaactcaaataacaagaatgatgttttaaaatttgacagaatcctgtgtgacgttccatgttctggtgatggtaccatgaggaaaaatgttaatgtttggaaagactggaacacacaagcaggtcttggtttgcatgctgttcagctgaatatattaaacaggggtttgcatcttctaaagaacaacggtagattggtttactcaacctgttctttaaatcctattgaaaatgaagcggttgttgccgaagcgttaagaaagtggggtgacaagattagattagttaactgtgatgataagcttcctggcctaataagatccaagggtgtatccaaatggcctgtctatgacagaaatttgactgagaaaaccaaaggagacgaaggtacactagatagtttcttttcaccatctgaagaagaggcatcgaaattcaatttacaaaattgtatgagggtttatcctcaccaacaaaacacaggcggatttttcattactgttttcgaaaaagtcgaagatagcactgaggcggctacagagaaactatcttctgaaaccccagctctagagtctgaaggacctcaaacaaagaaaataaaggtagaagaagtccaaaagaaagaaagactaccacgtgacgcgaacgaagagccttttgttttcgttgatccacagcacgaagctttaaaagtttgttgggatttctacggcatcgataatattttcgacagaaacacttgtttagtgcgtaacgccactggtgaaccaacaagagtggtttacactgtgtgtccagcattgaaggatgttattcaagcgaatgacgataggttgaagattatttattctggtgtaaaattgtttgtctctcaaagaagtgatatcgaatgttcatggagaatccaaagtgaatcattgccaataatgaaacaccatatgaaatctaatagaattgttgaagctaatttagagatgttaaaacacttgttaatcgaatctttccctaactttgacgacattcgttcgaagaacatcgataatgattttgttgaaaagatgacaaaattaagctctggttgcgcctttattgatgtgtcaagaaatgaccctgccaaagaaaacttattcttgcctgtgtggaaaggcaacaagtgtatcaatttgatggtttgtaaagaagatactcatgagctattatataggatctttggtattgatgcgaatgccaaggctactccaagcgctgaagaaaaagaaaaagaaaaagaaacgactgaatctcccgcagaaactactaccggaacctctactgaagctcctagcgctgctaattgatagttatcatgtttcttatcccctccactgtaaagtaaatgtatattattaaaaggcaaaaataagaatataatacttcagtaatgagccttttttattcggtcttgttacttcttttttacttcatttttttttttttttttggatagtaaataatgcacttttgactagatcttgagtatttagttgaattgaaattaaagatacagtgtataaaaattatacaaaaaataaaggaaacttgtatattgaaaataggattgccaatacatggattgagacagagaattttttatcttcatatccagatattcgtaggaataacaaagttttagtgacccaaggtataaattgcgaaagacctgcggagttggcggcgaacactgactttttgggcatcaacaaaggaatcaactacaactttgatagctctatccaaatcataagaagacacaaattcagataatctcattttagcaaaagattctgcaattcttagaatagattctaaatgacgaactgtgattggaaacgaacctgtagaaatactttctcttctcaaatccgcatataccctgctaaccttatccatatccatctgatgcaatttagggtatatttttgtcctcgcatagtgaatatatttcatcaataattcctgtggaataggcgagatctcttcctccttcttcctttgtctttgaagtcttctttgccttgcattaagctgctcatttatttcatcttctccttgttctatcgccgattcgccattatttttaagctcttcgccttctcgatcttcatcgttttctggatgagatcttacatgagaatcgacaacaaatgtggccaatctttcgtctgcctcttcatcaacaaggtctctgacaacacataaaatatcaaatctagacagaataggctcggtcaaactaacattctgagctaaaggcaaggttgaattatatctaccaccattaggatttgccgcagcaataattgagcagcgcgcttgtaatgtagtaacaataccggccttggaaatggaaatactttgctgttccatagcctcatgaatagatgtacgatcctgatcgttcatcttatcgaattcatcaattaaacaaacacccttatcagccaatactagcgcccccccttctaaggtccattctttagtaataggatcttttctgacggatgctgtcagaccgacagccgaagcaccctgaccagttgcaaagaccgctctatgcgctgttttctcgacgtattttaagatttgagatttggcagtacctggatcacctaataataacacattgatatcaccacgaatagaatgttttccattgacgttttttggaacacctccaaataatgagcacgcgactgcagttttaatatctctatgaccatagatagacggtgccatcgatgatataattttatcaattataccacgatccctagaaatctttctaaattcacgttcttcttcttcagtccaactgaaaacatccaacccttcttcgccttcgttagctgtattgccctctcttctttttatagaatttgcctcgataattgttgcaaaaacggggaatccgttctttgcattcaagttaccatcgtagttatttttgtagatgccggtaacttctacctcttcacctggcttggatacatctaccaaatccgccaacaaaatgacttctctatgtcttggtagacggcctggaggaacggttccgggagcttcctggagcgtaaccctttgataatttcggtacacagttttttctccattgactctaaagggaccttttgatttgcagtttgtacagaatgagattctaatttcttcattagaatcttgaaaaaatgggcccaaaatggagccacatttcaaacaattgaatttgacatattttaattgagggaagactcctgttcttcttgtcaccaccccagtgacgcgtactagagaggacaaattagactcacgcaattcacgtaaactgtatattgttggaaaatcagagattcttacgtgaatttcggagtgaatacgggcataatctgggtaatgcaattctgttgcctccatagccacgagatcgaatattttcaacatttcttctggacatttagctaaaaatagtgccaggatggctttggactccgctaagtgtctataattaacctccaaagattcagaattcatttcacctaatgttctaatacgtgcaccatatacagaacgacccgtttcatctgtatattccagcaggaatgattttaactctctggcaatagttcttgagacattaggttgtgttatccattccgagtaactgttagccttaacgttactcagagattctaaagtaagttcttctcttaatgggtcaatgtccatgtcactcaatagatcgtcatcactattctctaagtcctcatactgccttctccttcttcgtctttgcacaggaaggcccatttcatcaagttgcgctgcaccttcttgttcttcgtcctcgtcatctatgtaggcaacatttctcaatagcctatctctttcatttagttgagcatcaatgcggcgacgttcgcttaaagatagttcttgttgttccctgtcgtcaacttgatctggatcatatctatctctattatgatcagccgcataatcctcatacatattatcgtccatcaaatctacttcgttcatttgttcttcaacttcatcaatatctggtacatcgtcaacttcattatcgtcaccttcagggttaatcatatctggagaaccaataggtgatgaaactgggttcatcccccctctaaaatgttgctgaggtgaggatggcggtagctcattttctgagtccgaatcatcttcctcacgtctacgtcttctattatcagacatcacttatattgtagttgtgttatacttcttagaaaagaggcaaagaggtgtgtggagtattattaagtaaactgtaccaaaatgtgtagattataggatattcaccatttactttctggtttcgtttctcgaaatttttcgttgtcctattttcttcggtaagtaattagatttcctaaaaaaggcatatgataaataatattacacgcgattccgccatcttgggtttcccacatacatacttcacgaagaaaagaaagaatttagtattgtgtaataaaattgatgtttatgtttaaatatttacagaatgtttaaacaggtatttaatccatttagatgaaaagttagtccttttcctttttagcatccaaaatctcaaattcagccttccatactgaattaccttctttcgtattcacatccttgaataatttttggaatatatcattataccaatcagcagctaaaggttccaacccttcctttacattgtctggaagttcctcccaatcatttaagttatctttagggaaaataatagtcttggcaccagatcttttagcggccacagctttttctctcaacccaccgatacgtaaaactttaccggtaagtgtcaattcaccggtcatcgcaaccgttgggtcaatcgacttattcaatgctagggaaaggaaggaagtggccatagtgacacctgcagatggaccatctttaggggtagcaccttcaggacaatgcaagtggatagacgccttttcaaaaaatctgttctcagggaatttttgtgctaaatacatcttggcgaatgaataagcaagccttgatgattccttcataacatctcccagttgcccggtcctttcaaatgttggatgcttgcagttgtgtaaaggttgttcaaggacagattctacataaagtgagcaacctcccatattagtccacgccaaccccataactacccctggtggagttgtttcgtataaccggtctgtagtgtagactggaggcccaacgtaatcttttaggtttttctgggatatggaaacattgatcttttcagaggtctttaaggcttcaatgtcatcgcttgtcttttccgaattattgtccttagtcttctccgatgagcttttggcgttattttccgccttttcttcggaagaaacgctttctttaggcttgctgtcggctgatgacgttggggaatcttcaatactcaacttctttaccacttgtagggctgctttacggtatattttctcgatgtgttttttcaaattccttacaccactttctctacagtagtacttcattaacgctgttattgcatcttctgtcatatcaacatgagagttttctagaccagcgcttttcttggcacttggaactaaatactgctcggcaatcttaaccttgtcttcagcaacatatcctgtcaactcaatgacttccatacgatccagtaaaggtcttggaatagtttccaaagagttagcagtgcaaacgaaaagcacttttgataagtcaataggaatatccaagtagttatccaagaagctgttgttttgttcagggtccaatacttctaacaatgccgcggacggatcgccgtgtatgccgccgtgtccaatcttatcgatttcatctatcaaaatcaaaggattttgagtttggcacttctttaatgcttgaactactctgccaggtaaggcaccaatatacgttctcctatgaccttttatttctgccacgtccgtcataccgcctacagaaaatcggaagaatttcctgttaagagctctagcgatagatttacctatggacgttttaccaacacctgggggtcctacgaaacatatgattttaccatcgactttacccaatagtttaccgacggcaataaactccaagatacgatccttgacatctaccataccataatgatcttcatctaaaattttctttgctctcggaatggaatactgttctttggaatgttttccccatgggatcgatgttaaccaatccaaatagtttctgataacgccaaattcggacatagaagtctccaaggtacttaatttagttatctcatcatcgaaaattttttgaacgctatcaggcaattttaatgacttgattctttctttataagtgtcaatcaatttgtcacggccgtcgtcaatacctaattctcttttgatgccctttaattgttccatcaaatagtattctctttgtctcttttgaatctttgtctctacatctttggagattttgttctgtaattcggcattcatcaattctttcttaaggactagtagcgacttttctagtctgtgctcaatgtttaaagatgacagtatgtcttgtaattcgtcttcttcgccggcagaaacagcagcggcaaaatctgccaatctagctggttcctcaaaaatgttcgtggtcgcagattgaattgaagcagaaaaagttgcaatttgttctctgaacatcgtgttcaattgagaaatttctttaaataccttcaatatttctgatgttagcgcattaataacgggtgactttctatcaaacggttcatcttctaaattcaacacattgacaagggaaacattataattttttaagaattctgtggggttaatgtcctcaccttcttgaatatcgtctaattcttcagactcttcttcagtggcttctactctcttatgatgttgcaattctgagtctggtatcctctccaccacaatatcctccaacttaggcgtagcagggctggtgctttcttggtcttctgggttgttagcgtcttcaacgacggtcgtttcagtatccgtatcctttgcttgttcttttgatttttccttttcctcgtttggtggaaataattcatcaatttttattctcctgtgaggatataaaagagcagtcattgtttcagtgcccgtcttttcgtctttactcgggaaagcgctagttatttgagccagaacaccaacatcgtatacatcatttttatctgtgattacatcagtatcttcttccgagttcttcaacatgaaagcgccaatgtagggttgctggcggtctaacatttccttgattgccttcataactctttcgtccgatatcacaaccgccttgtagaaccctggaaataagggccgtctggctattggtaatgctagcatttgcgggtatacttctggtacatcctttggaggcttttgtttcgaacttccatctccagaatccgatcgactggatgatgactgtccacctccagaagcggagcttctggagtttttcgaagcttcaccttcttggtccttattaacaatttcatcatctcgcgtgggctcaacatcattgtctgtatctttttcatcaggtactatcttgacatcttcatcctttttctgagatgtactatcatctttcgccagaatacttttgccgctgtttgtagccatgaaatgccgagcaaactgtgcatcaagttgtgcaaagtgttccatgtaccttggatccttcaattgatgctggaactcttgccatgttggactcttaataatatggctaggtttgatattctctacgtcacgcacggtcaaggtcgatgcgaaccttctttgagaaactgcagcagtcttagcgatagatcggtaatattggatagctcttgtggtcctcgccactgtgctaagggtctttgtggttcttgttcttagcatgctctatttgcaaatcttttcgttcaagcacctcgaaaaccaaaagaaaaaacaactaaactttgaaacagctgcaaatgcacactgtattatcaggttttaggtgtcctagtaaccgtatcagcttgtcgttgctgcaataccaatgcaaaagcatggctaaaagacttcgtctgacttatttccttccggtggcaaacatcatacaccctttacaaagcacccatacattacattgaatacattacacactaacaataaaatattatctatatcgttacattcattaattacacgagaaccaacgaccagcaggaaatagccccgtgctattccatcctgacagctagcaacttttgcgatctaccacctggttttgtcttctcaaggcacctcttcgtcgtcctgctcatacattagttgattcttcagcgcctgttgttgcctgtatttagccaagtagattttcaacacctctgcatagttctcgaatcctaaggcgtgcaatgatatgagaatgtcttccccgtttatcgtctttcttttgtcagcagcgcatcgatcgctggcctcgctagtcacaaaagaaatgagctcactgacacactcctgcatgcactctttcgcatctttcgataccttagcactcggtgggagagtattcttcatgagtcgcgctacattgttgatgggtagccatctgtcctgctctcttagcgtggaaatttgctgcaaactgccgctggagctagcgtttccaccgttctcctgagtatcctctgggcttgtgctaacatgttcggactcgttggtattcatattctcgagaggtttgtgccacttgtgttactatctagcttagtcctgctcttgagtttgattggcggaaagctactattcgcagctctttttttacttagtctgaaagagcggaccaaaaaacgcacgtagcgcgatattgtcgtggcatcgaacgtaatatggtacttctattgtgctatattttggcagaaggtttgcagtaatcgcagcctggagaagacaatgcgtattagtagcagtaaagggccacagatagggtgatttgaagttgattctgcttttgtcagtgaaggaaaagaaaaaatggcgaaaaaaaactcacaattgccctctactagtgagcagatcttggaaaggtccacaacaggagctaccttcctcatgatgggccaacttttcaccaaactggtaacgttcatactaaataatttgttgatcaggtttctgtcgcccagaattttcggtatcacggcctttctagaatttatacagggcacagtgttattttttagcagagatgcgattcgtctgtcgacgttgagaatctcagactccggtaatggaataatcgatgatgacgacgaggaggagtaccaggaaactcattacaagtctaaagttttgcaaaccgcagtcaattttgcttacattccgttttggatcgggtttccactgtccattggtcttatcgcctggcagtacagaaacatcaacgcgtatttcatcactcttccattcttcaggtggtcgatttttcttatctggctgagtatcatcgtggagctgttaagcgagccattcttcatcgtcaaccagtttatgttgaactatgccgcaaggtcaagatttgaaagcatcgcggtgactacaggatgtattgtcaattttatagttgtttatgccgttcagcaatcccgctacccaatgggggttgtcacatcggacattgacaaagaaggcatcgccatattggcatttgccttgggaaagttagcacattcgatcaccctgctagcatgttactactgggactatctcaagaatttcaaaccaaagaaattgttcagtaccaggctaacgaagataaaaacgcgtgaaaataacgaattgaagaaaggctacccaaagagcacatcttattttttccaaaacgacattttacagcacttcaaaaaagtttattttcaactatgttttaagcatttgttgacagagggtgataagttgattatcaattctttatgtactgtggaagaacaaggcatttacgctctattgtcgaactatggatcgctactaacaagattattatttgcgccgatcgaagaatctctgcggttatttttggcccgtttattatcctcgcataaccctaaaaatttaaaactatctattgaagtcctggtgaatttaacaaggttttacatatacttatcgttaatgatcattgtatttgggcctgccaattcatcctttttattgcagttcttgattggctcgaaatggtccactacttccgttttggacactataagagtctactgcttttacatcccatttttatcgcttaatggtatttttgaagcttttttccagagtgtagccactggtgaccaaattttgaaacattcatattttatgatggccttttctggtattttcctgctcaattcctggcttcttattgaaaaactcaaactatcaatcgaaggcttgatattgagtaacatcattaacatggtgttgagaatattgtattgtggagttttcttgaataaatttcatagggaactgtttacagattcctcttttttcttcaattttaaggatttcaaaacagttattattgctggctcaacgatctgtctacttgactggtggtttattgggtacgttaaaaatttacaacaatttgttgttaacgtattattcgcaatgggattgttagcgttaattttggtcaaggagcgccaaaccatacaatcttttattaacaagagggcggtttccaattctaaagatgtataaacaaaaattcttatataacttaggcgacacataatatgcgcttaaataacatatagtgagtatattatcaaaaagcattcatttttttttatttattagtccttcagaaagttagtttgtatgtactatatgatgtgaaagtgctgaaaaattacccaataaaagataggcaaccaagagagaagctatttcaccgtaaagaaaatccctttccttgtcaggacactatgtcatcaagcgaaaacacgttactggatggaaagtcagagaacacaatacgatttttaactttcaatgtcaatggtataagaaccttttttcattatcaaccattttctcaaatgaatcaatcccttagatctgttttcgacttttttcgagcagacataataacattccaagagctcaagacggaaaaattgtctatctctaagtgggggagagttgatggtttttattcttttatttctatccctcaaaccagaaagggatattctggcgttggctgctggattagaattccggaaaagaaccacccactataccatgcattacaagtcgttaaggcagaagaaggtataacgggttacttgacaataaaaaatggtaagcattcagcaatctcctatagaaacgacgtaaatcaaggaattggtggttacgattctttagatcccgatttagatgagaaaagtgcactggaactagattcagaaggcagatgtgttatggttgaactggcatgtggaatagttattatcagtgtatattgtcccgcaaattcgaactcatcggaggagggtgagatgtttagattaaggttcttgaaagttttattaagaagagttcggaatttggacaaaattgggaagaagattgtgctaatgggcgacgtaaatgtttgccgggatcttatagacagtgccgatacattagaacaattctcaattccaataacagatcccatgggtggaacaaagttagaagcacaatatagggataaagcaatccaatttattatcaatccggacacgccacatcggaggatatttaatcaaatattggctgattcacttttaccagacgcgagtaaaagggggatactgatagacactacgaggctaattcaaacaagaaatcgacttaaaatgtatacagtctggaatatgttaaaaaatttaagaccttcgaattatggctcacggatagattttatcctagtgtccttaaagcttgaacgatgcataaaagcagctgacattcttccggatatattgggctctgaccattgtcctgtgtattctgatttagatatactggacgacagaattgaacctggtacgacacaagttcccataccaaaattcgaagcaaggtacaaatataatttaagaaaccataatgttttagagatgtttgccaaaaaggatacgaataaagaatctaataaacaaaaatattgtgtatcaaaagtcatgaataccaaaaaaaacagcaacatcaaaaacaaatcgctcgactcatttttccagaaggtaaatggagaaaaagatgacaggattaaagaatcctctgaaattccacagcaagctaaaaaaagaatctccacgccaaagttgaatttcaaggatgtctttggaaagcctcccctgtgcaggcatggggaggaatccatgctgaaaacatcgaaaacttcggccaatccaggtagaaagttctggatttgcaagagatctcggggtgattcaaataatacagaatcatcttgtgggttttttcagtgggtttaaatatgaaaacgtcagctgatattttgggagaataaaacactttcttctatgcccaagtttttttaaataataaactgatattctatatacatttacagtcttgttcttcttcttccattacttttttcagccataggcggtcatcgtcagtaacctccagaagtctcaaactggaagattcttgtagaattgacactgttaatggtgaaccgacgagttcatcagtagatatgtatgtactgatggacgaagaaaatgtatctttatccgcatgatttactctgatgtaagccagcttatcgtcaacatgcaggaatgaatattctacaccttcaccaaaaataccataactacgtttcaatgcgttatttaaccattgcctccatgtcatttgatcaatagcatgtgcatcgtccacatcttgatcgaatgaagtactataaatattaaagtacgttagtagtttatttctcttcggtagttgagactcaaaaagtcaaaaatatacatacattgataacttgaaatattgccattctctaaaagtctttttccccatcacaactggccatttatcaaactatttatctgccttttcttattctgattatcctataaagctgaacagtaaagcttgtaaaattacgcgatgacttatgtattgaagttatgacgttctcgatgatcttcagtcaaacaaccactttcccgtaacatatgatatatcccacccgcttccttgtacgcattattacggttctgctttgaagatggagattcagtacttgcagttatttgaattgcaccagtactgatcatgccaagtttctttggcttgtgaaagaacttgatattctgtctaaaggatctgctcgtttttgtttatgaaaagtatatggaattatctactctatgtaaagtaatctctctactggttttcgttagatggcgctgtagaatcaggcctgtcgatgttttcctcatttccttctggtaatgtatctggaacatcggtggtcgtaggttgatctgtatatgatgtatgctcttcttcaagtgttggaacatcatcttcttcgatttcaaaattactaccctgatccatgaaactggataagtcattggcgtcttcatcgtggccagcaagcaggtcatctgcttcatccaaaaattgatcatggatcagggatgagtagcttggacctgttctgtttccaaaccttcctctaattttggagatagcatgcgctatattagtttttgtgtgctgtaaaagagacccgatatttgagaaaacgtaaaatcctgatttcacaatgttattgacaactctgtcagtattattgttttctattaaaccatcgtcacctagcctaatttctccaaaccttgcaaatcccccatttcttctgatacctctgtcatatacaaaccatgcggcaaagaaaattattaaaagaattgaaatgaaaataaatgcaaagggaccggcacttactgagtacttttccttgaattctttttcttttcctgggcaagcatgtggtgatgagggagcatccaatttcaggccaccctcacaggttgatagagggatctttctgtagcctgacgattcaaaatattcgattaaatctggctcttttttacaaacgtctgcagcatttgctgggcttagtcctttgactaatttacaagtaccatcgttagctttgtaaaagttgtaatcacactcgaaatcttgtcttgtacaagaacagtttttgatatttcttgaaaattcagaaagtggaatattcccaataaaacaattttcatcggttttacgtaaaaactcggtttggtgaccaaataggcaattgcttttggaacccagaggagagtatttataatctgcgctttccttaccagtgatgtcgaaatcacattgtctttcgaagatgtttctaaaatcaattgtgtacgttctaaatgagctgcctccaatatctgctgcctctccaaacagcaaaaatctcaaagcagaatccctgggaacagtggttatatcctttactaaaaccttatcagcgcagaatttataatctttccatgttttaccaaaatcggtagaataggaaatagaatcagtttctgagttttcaggaactaaaactaaaatcccaccgtggtcaccgtattcccattggtgaggagtcttcttaacttcagcccacgtttcgccaccatcggtggtgaagaaggtggaacattctttatatggtaaaaggttaggaccaacgttgccaacgccgaacatcattcctaatgcagaaccggaagaatatgtatctctaatatccttacgttcagtatagccatgtaagtgcaatgaacactcatccagtgatttggagctgcaagaaaacttttttccttctgaatccctcttcggaggtttcaaaaagttccaatctgaaccttcattaaaggtgatcttcgtcttcaattgtttgtcttctttattctcggcgaccttgtcactatttgaaacgatgttggtgagaataatgccttcgagaccttgaattttttcaaagtcaacatagccgaatgtgtttctattaacggcatgctccaacgtgacaaaagaagtaccatttgagttggatttcaaaagattgccaaaatcgcgtcctggtactaagtttgttgctaaatgtaagaatatcgatcctttctcagactctaatatagtgaatgcctcttgcttcccaacatcttcatcatatgggaattttgcctcggcaaactcagtaccatcgatagttacgtatgctctcaattcgttgttctcatgaggaacagcaacgatgatatagccaccagtggataagtagccgataatattttcaaagacggtatttttatcatcctggaaaaaatcagtagaagaaactaagcttcttgtctgcgaagacttttccttcacttgacacataaccatatcctcatttgacggatatttgaaaagtgagcccgcaaactcacaatgaattgcattatcaagcatttccgtaaacgtttcgcccccatcattggtcaggtatgctaccgcatgacattccggacttaagattgactcacaattcttaccaccataatagataaatgtatcctgtgccttagcgttaaagtctaatggcatacctaactgcctagcctcgggcaatttagcagtcataaaagagtatcccctatcatgggtagagaaaatgctacctttggaaccaaacagataagctgaagaattgtagtatggattaaacacaacttcaataattgtttcaccattactgtcgaacctttttattgtttgtccaccatcatgagatatataagcttctcctcttgaattgatcatgaggagggattcgtcggtgactgtgtcaaagtattgatagaattgaatcttgaaatcaaatttgttttctgtaaccactatttctttatcattcgttcccttctttggaactccctcacacgaaatatccactgatttgactgtcattggttttttacatttatcacctttaactagttgcaatggttttacaggcacagtttttttctttgtcttatcacatacgtcagagagaacgattaggttgtagtctggtacgcatttcccggtcgcgtccctaacaaattcaaacgcgcattcgtaatcagcctcggtacacttgtcacaagcagtctcaaataattgtaagtcttcaaaaactttcttcaccaagcactgagcgtcctgttttcttcttctgatcttgtacttgactccattgacacacttcccctcagctaaattccaatcctcgaaatcattttcttcgcatgtcttatcattaaaggctgttgaaaaatcaattgcatagatgaaattcgttgtaccatccatatgcgccaaagtaaacccatttagaataaatttagctccagatccgtcgggcgttgtattcattacttcatttgggtagatagtagtttctagctgatattcggtccaagttttaccttggtctaaagagtaataaaattcggattgaggatcgtcgtcttcatccgcattatacggtatagccacaataacatttccgtaatcaccaacagcgtataaacaaggaaaatcaaaggcgagtttccatgttaagccaccatccctagaaataaaggttctttgatctccccagtcgaagacactaccatcgccaacaatacctgttgtcattagaattccggcggttggagtggaaccctcccgtgtgtaaaacatattttgaagcgaacaattctcaaaatcagtaatatcacagtcgaatgagtctgcgttatctggatcaacaacttttaacattgtccatgtgaggccattatcaacagatattttggttacccccttactctttactcctttggcttttcctttacggttacgacgcctagatagagggtaaagtgaggcaatcatcgttcctttcaagtaagtaggttgataaaaattaatataaccaaacacctcatttgcggtccatgggatgggggaaaattttaacccttgtgagtcggaaattaaaatttcagacacgatgcccttatcctcctcttgatcacttctttccctactcatgggcaagataattcttcccatagcgtcctcatatatttctccttgcatagaatgccttaactgagtaggcatgtaagccattttaaagtttgacagatcatttgatacccacacatccatggaagacatatcattatatctgtcgccctgggttaagacaaccatgtgagatttcaatatcctgtaaccattgacgaccttatctttaaattggtcaaattcttttagtgatttgccccagtccgtagttaggaccaatttactttcggtgtaaggagaactaaactcatccataataagctgcatattttgaaaaagacagattattgaggtatcactactttcaaggtcagaatctttgctggtcttggcaaagccacaatcagaaatgctgataggactattttcgttcctttctagagaagacttgatctcagaaaaggattttccaccatcattacttgcaaaaaccttgtctgtgcaacgtgtaatattaaatatttcaaattgtccctcttcgtcccccgaattctcttcattgtcattgtttacttctgttttctcacaatagttgcactttgcaagaaaatagttcttattcaagggatgggtttctatatagcattcacgaggtgaaatactttctccggagtcaggtagcgttatacgctcccatgacttaccttgatcattggttatataaaggtacgacccattcattgccgttgcaacggctctgtcatgtctattgaaggggtcgatgtatatccaagtgatttcgccttcaatgccttcaactttttcccatgtttcaccatcgtcaaagcttatagtaacggaggtgtcttgttttctaattaaagtgttggaatcatcaaagcttaatatatcaaatgaatcttgcgcgatagtctttgtcactttgggggtgaattcttcggcattagttaaaggaatgagaagtaaggcccaaagagaatagacaaaatgaagtaatatcataacgtgtgatgactactggacacttcagggcttttccagatatacagagctttataatacaatctaagggcaaaataaaaaaggaaaaagagtacggtagttgagaaaaaaaccggaaaggaattgctttaaagatcttagtagaatgaaatagtaccacctactcgcctcctttttttgtgcttcttgagaggtcttttgagctgttgcatcatgctgttatttagaggttattttttgaccttggtttttccttcttttcgccgtactcagcccgagaaaaaagcagcgactgcactaaactagaggaaagaaggcttaaaacatcacgcgatccatataaagacccgagtagttggagagattgactacttgacgttcaaaagaacatacataaggataaattcgttcggactttttaacttacacacatcttttggtgttcattcaaggggcggtagtgcttgtagtccgcacaggcggatactttttagtttgggaagagttaactggagagggcagtttactttcacatactcttttatctttctgaagtaaaatgtgatgtacctacaagcaatgcataagctcttgagttttagatctgtttcaccctggaactcaaaattcttttactcgaaatttttactttttttttttttgtttctgcattctctcagattttagatgatgcggttttttacagggcattgaaacaattgcagaaaagcaacatactaatatatcataactttttactcttgcctctcagaaactatatatacgttgtaatcattttctttcttctaatagctagttcgtttgaactacaaggaaataaggcagagaaaaagaaaggaaaataatatgccaaagagaattgtatacaatatatccagtgacttccagttgaagtcgttactgggagagggtgcatacggtgtggtatgttctgcaacgcataagcccacgggagaaatcgtggcaataaaaaagatcgaaccattcgataagcctttgttcgcattacgtacgctgcgtgaaataaagatcctgaagcacttcaagcacgaaaatatcataacaatcttcaacattcaacgccctgactcgttcgaaaacttcaatgaggtctacataattcaagagctaatgcagacagatttacaccgtgtaatctccacccagatgctgagtgacgatcatatacaatattttatataccaaaccttgagagcagtgaaagtgctgcatggttcgaacgtcatccatcgtgatttaaagccctccaaccttctcataaactccaactgtgacttgaaagtatgtgatttcggtttagcaagaatcattgacgagtcagccgcggacaattcagagcccacaggtcagcaaagcggcatgaccgagtatgtggccacacgttggtacagggcgccagaggtgatgttaacctctgccaaatactcaagggccatggacgtgtggtcctgcggatgtattctcgctgaacttttcttaagacggccaatcttccctggcagagattatcgccatcaactactactgatattcggtatcatcggtacacctcactcagataatgatttgcggtgtatagagtcacccagggctagagagtacataaagtcgcttcccatgtaccctgccgcgccactggagaagatgttccctcgagtcaacccgaaaggcatagatcttttacagcgtatgcttgtttttgaccctgcgaagaggattactgctaaggaggcactggagcatccgtatttgcaaacataccacgatccaaacgacgaacctgaaggcgaacccatcccacccagcttcttcgagtttgatcactacaaggaggcactaacgacgaaagacctcaagaaactcatttggaacgaaatatttagttagccatcattatcattaaaatatcaacccgaagaacaatgtatacatatacatatacgtacacatatacatatgtacatatgacatacgtattagccgctgaggacgcggacgtataaaaggacaatacttatatggagctaaggggagcagttacgcaactccgtgatcgcgcgccacgggccgtcggcggctgttaattgaagaaaaaaaaaatgaagaaccacaaggggtgatccatataggtgactagcatcatcccctgcgacgcgcggcccgccgggccaaaggcgggcaatgcgcgctgctgattggcctcgaggacaacgccctcaaccacatccgcaacagccaatcccatcggagcgtcaaactaccaaagtagtgattgtatggatgaccactgtattgtggacggtaagcgcttgctggagcaaatgtgtaatcaagttgctgtgtatatatagacgttagatgtgttctaccccttcttttgtcttgtgcccaccgggcttacattagcacacaaagcagcaagagaccgtcttactagacaatagcggcaaaacaaacaacacatttctttttttctttttcacatattgcactaaaatgacaatttctaatttgttaaagcagagagttaggtatgctccctatctgaaaaaagttaaggaagctcacgagcttattccattgttcaagaatggtcagtaccttgggtggtccggttttacaggagtgggtactcccaaggcagtgccggaggcactgatagatcacgtggagaagaacaatttacaagggaagttgagattcaacctttttgttggagcttctgctggtccagaggaaaaccgttgggctgaacacgacatgatcattaagagagcccctcatcaagtagggaaacccattgcaaaggcaattaaccagggtagaattgagttctttgataaacatctgtccatgttccctcaggatctgacatacgggttctacaccagggaaagaaaagacaacaaaatccttgattatactataatcgaggcaacggccattaaagaggacgggtctatcgtcccaggtccctctgtcggtggttctccagaattcattacagtcagtgataaagtgattattgaggttaacacggctacgccttcgttcgagggtattcacgatatagacatgcccgtgaacccacctttcaggaaaccatacccatatctgaaagtggacgacaagtgtggtgttgactccatcccggttgatcctgaaaaggttgttgcgattgtggagtccaccatgagggaccaggtcccaccaaatacgccctctgacgacatgtccagggctattgcaggtcatttggtcgagtttttcagaaacgaggtaaaacatggtaggctacctgaaaacctgctgcctttacaaagtggtataggtaacattgctaacgctgtcattgaagggcttgctggcgcccaattcaagcacttgactgtatggacggaagtgctgcaggactcgttcttggatcttttcgagaacggatctttggactacgccactgctacttccgtgagattgactgaaaagggtttcgacagagcctttgcaaactgggaaaatttcaaacacagattgtgtttgagatctcaagttgtctcgaacaatccggaaatgatccgtagattgggtgtcatcgccatgaataccccagtagaagttgacatttacgcgcacgccaattctacaaatgtgaatggttcccgtatgttgaacgggttgggtggatctgctgatttcttgagaaatgcaaagttgtccatcatgcatgccccctctgcaagaccaactaaagtagaccctaccggtatctctaccattgttcctatggcctctcatgtagatcaaactgagcatgacctggacatcttggtcactgaccaaggtttggcggatctaagaggtctatcgcctaaggaaagagcccgtgaaatcatcaacaagtgtgctcatcccgattatcaagctttgttgaccgattacttggacagagcagagcattacgctaaaaagcacaattgcttgcatgaaccacacatgctaaagaatgctttcaagttccacaccaacttagctgaaaagggtacaatgaaggtcgacagctgggaaccagttgactagtgtttgtgcgcaaaccgagagatgagtatttaacaaaaaaaagaaaggaaatgatatgattatgattttatgtttataaagcttttatccaatgcgttgttttttcttgcatatttatactttttgcgctcatggagggagttaatcaatacgcatgacgtctagttaattcacaggtagtactgtatatttatatgtttacacaataattatgtattaagtagtgattagtaaaaaaaactaagaggttgaaagtcatcaacccttatattaatttcaacgaatttcgctgatgacgtcagggtagttctcttgcttaggtcaatgtaaaaatgccagggtaatacaaaaccaagctctgaaccgcccaacttatctgtaatgatgcatgtataccttacaatgattttttttctcctattatggaattaatattggaatccatgtttgtgaacagccttctccgcaatttagcttcaagctaataagtggttattgtttgcgcgcgcttgaaggcaaggatcatcgcttttttcttctcaccattgaatttaagggacgccgattagcataatacacttatcaacaacaaccggatgtgtgttatctatcagtggtggaaggattggtaagcaatttggtttgatccagaggactaagaaaaaaaaaacggctcatcaaagaaattagttcaattgagtggtttaatagacaaagtttggaaagataacagaagtagaaaaagtaaaaatctacacatgacactcaacacatgtggacagcaagagggcagatagataagtcgacactgcaaattgttgtgtatgtaatagccctgggtgcaggttggccaaaactgttcaacagctcgcccatttgaaggttcaacaggccgccagaaatgttcaacagattgtgccgctatgatacgtaacttatatatagcagcgtgtataatattaggaccataataaaatgaatggcatgaaaataacgacaacaatctcaacagcaaacaaattcacaatacagtcatgggcagcataaacttcatatttgctttacatcttttagttgttttatttttcatcatcgccatccctagctacgccatgtatccatttttaccatttatccttacatcgctcgtatttgctcgttctgataactctaataatcgttattgacaagttggttcaaggtcaaaaattttgttattacaatcactgagcaatacgctgtttttccatagtatggaggcatttttttttctgtgaatgtacgtatattttactgtatacttcattaatatttgggaaatagacatattttaagattattttttagatcctgtttacgtaaaagacaataatataggtgtgtaaattataccctaagttcttctcaaggatgtaagacttccacaagagaaccggcaattttatatgataatactattttttctttggctttacatgtagtcgtttattatcctattgaatcagcaattatcacatctcagctttcattacttttgatgactgtttctcaactccatgtcattcttacactgtgtatgatactaatcgatagatgatcgttgattattccttcaacagattctgtctaaaaaatggtaaaactgttgctactaatcaatatcatataattgatccttattcaacaatatctacaacgaaaaaggagattaaaaaaatgcatgctaagtaaatgaaggttttcatctgtccctgatgtttttcttcttcaagcacgttaaccagtaatcaaggtctcttggcccagttggttaaggcaccgtgctaataacgcggggatcagcggttcgatcccgctagagaccatttttttgcaattcaaataacgtcgtttattttttatataaaaataaaaatcaaaaagaattgcgcaagcccggaatcgaaccgggggcccaacgatggcaacgttggattttaccactaaaccacttgcgcttatttcttggaagtgttgtatctcaaaatgagatacgtcagtatgacaatacgtcatcctgaacgttcataaaacacatatgaaacaaccttataacaaaacgaacaacatgagataaaacccggccttccctagctgaactacccaaaagtataaatgcctgaacaattagtttagatccgagattccgcgcttccaccacttagtatgattcatattttatataatatataagataagtaacattccgtgaattaatctgataaaccgttttgacaactggttacttccctaagactgttcatattaggattgtcaagacactccgatattactcgagcccgtaatacaacactttttttggtaagtagtttataataacatgtgttgaaagataacaaatgccacaaaatatcaatggctacttaaaagggtaattgcaaaccattggaatgaaatcctaatatcatcttcttacaccgcacgtgataataaactagtaacacgaatacaactaaacagatgatattatagactttcattccaacacatctgttgactagtaagatggatattagtcaatagatgatgtttcttattccaaactatcatgggtttgtaagaaaatttattttgaggggaattgattacatttcctttttttttcaatgtactttgaagttttttcttgtttaacaataagcttgcctaatcattaaattagtgcataaaaaaaaaggtaagccgagattaaataagtaaacaaagacatactaaaaaaaatcattctggtacatacagcattctagttaatgttagattagcagtggaacattccatatttaatcttgtatcattattaaaataaggataagtctgagaagtccattcaaccgggacttaaccgccactttaattaaatctatgcaggattacccttgtgtaggccacataaaatttactggagatttctgtccggaaagttattgaaagcttttaagtatacttaaatgatttctcttttccatttctacgttgcccttttatcaatcttattgtggcatcgatccttgtacgtctacttattccattatttgatgaaaattgaatcccgtctctccggtcatattattttcttcaccttttactgccgtatacaaatattccctctcgacgtgtaccatcattttgatccgtgacatagtaggaatagatggattatggtcgattgagcttccaatactttgcgtattgagcaagctatgcaaattaaaatatctataaactgataggaaatgtatatactgaagaaaatgtttattacttgttacattgttttgattacctgtgcacgcattataccttatccaaacccccggatccttttcttcttctttttggctttttgagaattacgcggttgtgaatcgttcacaaatgatatctgcgaggaagggggctgcattagagtaaatgctggtgtcattgaatctggcaggacacttaagttttgagtggattgtgataacggagtagctttttgtgattgtgtctttaatattcttttcctccttgccagtccgctactttgtgatgatttgatcgttggaatttgagattgcgaatttaaattaaatggaggcctgccattaaagggtgctgaaaattgactatcaaaattaaattcattagattcatcttcttcattgatatcatccatatcccaagaggagataatatcctggtaaggaccacttagtgatcgtgaaatttcgttttgaatcggttcaaaaagtgatggtttttcaagtctcgctaaactccagataatgtctttgactatctcctttgtcagcagttccgcttgcggggataccaaaacccaacattgcaataatttgttgtaaaagatatccaagcccggaacgtcttcatgtaaaaacaaatgtagcaatttctcaaaaccaataaatgtcacatcctgatcctgatagtactggaaaaactgatctagtaatgaagaaaattcaggtatactcgcgaaggaatctgaattctccaaaaggtttttcaattttgaatggctcaaagacccactaaggatgctttcatctttcgtcttctgccaagattcaagcaattcgtttgtagctatagataagcgatatcccaaatcttggagatatttatcttcgtcgtgactgttttcatgctcaattaaattttggactcgagatatgcgctctctttccttcaacttaatttgagaaaccagtgcaccgatactctccttttcacgttcatcagcgttattgaaaagtgacgcccattcgggatggtcgacaatgatgggggtttcttgtttgttcggttcggagttttgagtgtttgataaagcatagtaataaacctcggatgagttccttagtttgactaaaaaatctacaactaactcaaaattttcatctgcatcctcctctctccgagattcatcgtctatatgatccagtgttaagattgtctctataccggtgggggtcccacccggaatttcaagaactgttgagcatcctaaggattgaaacaagtttgctttcctatgggaaaatacatgcatatagatgcgtttatgccgcatcgaatatacaaaggccaccagaagaatatggtcaggctttttaaccttttgtacagtgattctgagcgtagtatcatctggatccagatcgtgtttccaagatattcttctcactggatcatttgattctgatgcccctacgatgattatttcccttgaagtgagtaaaataccatttttatcatctatccgcttataatcacgtatgtttgaccatgctttcgcttgtactacttccgtttgccaattgttcataaagtcgatctcaatcattttggacctatcaaagaccagtattttttggaagtgtgaaaaccattctattcttttccatgacgataattcttctggatcaaaaatcgtaccgtggaggttatctattaactgtagtttccttttgttattattattgaaattctttggtatcctcccgatactccagttaccttttatatcaatgattgcgaattgttgtaagtcccaaggattgaatgcaaaatctaccacctgaaggtcgtctatttcaacaaaatacagtggttctgaactactaaccatgacatcacatgatcttgagtggacactttcaattctaaagatttggaaagaattttcggtgattatgcccaccaggtttgatctccgcccgatggactcagaggcccccggtatcttaatactcttgataggtgaatgcaattcgatactcgttacattgttatgtcggtttaaatgcaatgtattttgtcgtgtcagaactgctatatttaggactgagcctgttttacccgaggcatatgctatgatttcggttccgtctctataatttcttaaatctgatgctgtctgaatatattgagagtccagtcgattagccacagtaggatcccaaaagaaggcgtcttgcatcggcctcgaagagttagtactttcttgtaatgtatcatctaagttgcgcagcaaatctgaaggaatgtaatcttgaaatgaaactggcgtatcgcagttcacaccaaacatagaatcattaccaacgtcaactttcttaaaaaaatggacatctttcggtaccacgggtatcactggattgaccactatagatgtatccccctgattgtccgtatcttcatcaatatcgctagttatgagatcatcgtcggcatctgattcttgcaaaaccttgtcgtcggaaatatatcttatggcagtatcacaaagcagacttttgaccactatatgaaggtctagtgcatcctcggccaatgtatcatctactggtcttagccattgtgggttttcttgcttcttcgtagtgtaattttcttgcggacagtaaagactggcgccttgtacaccaacacccaattgcgagcctaacacatctgagcttggaatttgtccctcactcatgctcagcccatagaacgccttctctctttacttcaacttgccacatcaatatcattaccaaactaatatgaaagctcatctcggtttcttaatcgagagaataaaaattatcgtatgcccacagggtaacccatatttatatcaaatggaagaagcgtccattaagaaaaaagcaaaaaaagctgtacctgctattatggagaggagtaagcgcttttctcattaacgtaaaaagagaggtaagaaaaaaaaggaaggggacctaggcacctcatagtgagaagattgaaaacggcgtatcaaacaaatggttaaaatgagaagaataacacctacacgcctcctattcacatgcagatatatttcaaacaatgcttctccaccagtgcagcccttgaatgtgcttttctttggtagcgacactttcagtaatttctcattgcaagcactcaatgagttgcgtcaaaataatggaagctgtggtatagtggacaatattcaagtagtaactaggtcgccgaagtggtgcggtagacagaagtctattttgaaatacccgccgatcttcgatatggcagagaagcttcaattgccacgcccaattacatgcgacaccaagcaggaaatgttggcgctaagcaaactgacacccagtcgccaaggaaatccggagaacgacggctccggtgctccgttcaacgcgatcattgcggtttcttttgggaagctcattccgggtgacttgatccgcgcggtgccattggcgctaaacgtccatccttcgctacttcccagacataaaggcagtgcacctatccagcgagctctgctcgagggtgacacttacaccggtgtaactatacagacactgcatccggatcggtttgaccatggtgcaattgtagcgcagacggagccactggcgatcgcaacaatgctgtcaaaagggagagtcaatgattcgacggcagattttaattctgagggcctgcctcggaggactgccatactgatggaccagttgggcgcccttggcgcccaacttttgggccaaacgcttcgtgagaggttatatctaccacagaaccgtgtgcaagcgccaacagcttacaaacccagttacgcccaccgtataacaacagaagataaacgcattcattgggcgcgcgattctgccgccgaactacttaacaaactcgaaacgctcggtcctctgcacgcgttcaaagaagcgacagcggcaagaaaggacgctcaaaattcagtattaaaacgaatattgtttcatgagtgtaaagtgatgagagacgcacgtctagataatggcagtaaaccgggcatgttcaaatatgatgatattaaagactgtattttggtcacctgtcgcggcaacttactactatgtgtgagccgcctccagttcgaaggtttcgccgtagaacgtgctggccagttcatggcgcgctgcggaaaagatgcggcgccctgagtgaaaagttagttttcctgtaacccggctctacattcctcttttagtattcttcttctcccttctttcaatccctcatccatcggtctctcaacaactatggctgccaagccctacgcgctatgaagaaaaagaaaagtaggcccgccttctttcccagttgcagtttatttatgattcggaaagattgatgttagtaatggcttgtagttcataacagagtgaattaagtgtaggaagcccggaattaaatatatagtaaaaagagcacaggggcgtttacatcggggtaaaaaaaaatgcctgcaccaaaactcacggagaaatttgcctcttccaagagcacacagaaaactacgaattacagttccatcgaggccaaaagcgtcaagacgtcggctgatcaggcatacatctaccaagagcctagcgctaccaagaagatactttactccatcgccacatggctgttgtacaacatcttccactgcttctttagagaaatcagaggccggggcagtttcaaggtaccgcaacagggaccggtgatctttgttgcggctccgcatgctaaccagttcgtcgaccctgtaatccttatgggcgaggtgaagaaatctgtcaacagacgtgtgtccttcttgattgcggagagctcattaaagcaaccccccatagggtttttggctagtttcttcatggccataggcgtggtaaggccgcaggataatttgaaaccggcagaaggtactatccgcgtagatccaacagactacaagagagttatcggccacgacacgcatttcttgactgattgtatgccaaagggtctcatcgggttacccaaatcaatgggatttggagaaatccagtccatagaaagtgacacgagtttgaccctaagaaaagagttcaaaatggccaaaccagagattaaaactgctttactcaccggcactacttataaatatgccgctaaagtcgaccaatcttgcgtttaccatagagtttttgagcatttggcccataacaactgcattgggatctttcctgaaggtgggtcccacgacagaacaaacttgttgcccctgaaagcaggtgtggcgattatggctcttggttgcatggataagcatcctgacgtcaatgttaagattgttccctgcggtatgaattatttccatccacataagttcaggtcgagagcggttgttgaattcggtgaccccattgaaataccgaaggaactagtcgccaagtaccacaacccggaaacgaacagagatgcagtgaaagaattattagataccatatcgaagggtttacaatccgttaccgttacatgttctgattatgaaactttgatggtggttcaaacgataagaagactatatatgacacaatttagcaccaagttaccgttgcccttgattgtggaaatgaacagaagaatggtcaaaggttacgaattctatagaaacgatcctaaaatagcggacttgaccaaagatataatggcatataatgccgccttgagacactataatcttcctgatcaccttgtggaggaggcaaaggtaaatttcgcaaaaaacctcggacttgttttttttagatccatcgggctctgcatcctcttttcgttagccatgccaggtatcattatgttctcacctgtcttcatattagccaagagaatttctcaagaaaaggcccgtaccgctttgtccaagtctacagttaaaataaaggctaacgatgtcattgccacgtggaaaatcttgattgggatgggatttgcgcccttgctttacatcttttggtccgttttaatcacttattacctcagacataaaccatggaataaaatatatgttttttccgggtcttacatctcgtgtgttatagtcacgtattccgccttaatcgtgggtgatattggtatggatggtttcaaatctttgagaccactggttttatctcttacatctccaaagggcttgcaaaagctacaaaaggatcgtagaaatctggcagaaagaataatcgaagttgtaaataactttggaagcgaattattccccgatttcgatagtgccgccctacgtgaagaattcgacgtcatcgatgaagaggaagaagatcgaaaaacctcagaattgaatcgcaggaaaatgctaagaaaacagaaaataaaaagacaagaaaaagattcgtcatcacctatcatcagccaacgtgacaaccacgatgcctatgaacaccataaccaagattccgatggcgtctcattggtcaatagtgacaattccctctctaacattccattattctcttctacttttcatcgtaagtcagagtcttccttagcttcgacatccgttgcaccttcttcttcctccgaatttgaggtagaaaacgaaatcttggaggaaaaaaatggattagcaagtaaaatcgcacaggccgtcttaaacaagagaattggtgaaaatactgccagggaagaggaagaggaagaagaagaggaagaagaagaagaggaagaagaagaagaagggaaagaaggagatgcgtagatgccatttactgacggtgaagatactagaaactaaatctttcgccgttctatttatgtaataaacccattattgctcattgggagttgtaaatattaatgctcaatgtttatgtatatccctcgcacaggggctttttatttcttgagggggggactaattgtataattgtatgttttataaaaaagtatattgctcttttacgacttttggtctggtcccctatgctactaataacattttattctcttcaaacttcaacgttcaacctgctttgccgagacggcgattagtatcctacccaactgaaccttttctttttgtttcgctttttgttatacaatgcaatttcgtctcgctgtagtctttgggtatgtcctgtcaaattcgtcactacattttcaaaagttgtcttatcctttaggaggtctcgctgttgtttcttcaatgatcttgatttactaaccaaaaagtcaatggattgacacaatgtatcgtggtattggcgtaaagattcttcatccatactagtaaaatctgccataagcaattgcggtatatgctgctcttgctcacgctcctcttccttttgaagagattttaaagtcattggtggtgtatagtcaattttgaaattatccctcaggaagagaccagtagccgtttgctcatttttctccactgcatcgcatatccttttgaacaactcatcattcaacggttcttcctccctcttcgtaccaacaccctcagagccattattatccgataatctcaaaatgtggagcaagtttctgcgtatatgagatttattccatatgaatggctgtaacacaggatctaattgtacgagttgttcataaatgacatggggtcgttcatcttcaataagtttgctcagcttgaaacagtcattctttatggtttcttcttccaggtcaaattctccctttggtagtatcttattcaagcagttatctactacagattcggaagacgtcgttaaagtagaattctggttatagaggtcattttcaactgaggcatctgaaaaattcccaaaatcatcactagaatcactttctgcatctaatgcatttgtgacaggttctatctgatctctatcgctcatttgcttgctttgaaagaggtgcctttttctatcttgctacaccttaaattctcgtttgtgatacgcctaacgttttttttttttttcagttttgatagcaattcgcgaaactttttgtaacatcttctcttctcgaaaagcgaaaatagtaaacaataacttaaagcgtattggtattaatatatttagttgtagtaaaatcatttcaccaaacacacatacatgcgctatttgtattgagaaaatgaattttgatgcggtagcagatcaacagatgactgacagaaggtattttgctctcgaagtagcagaaagcgatgatgccgacagctcattaaattcttcatccatgggaagccccgcagtggatgtaggaagaaaagtttacaaaatcacttcgcacaagggttcagcagaagatgagagtcaatccttttttacttcttcagattctccaacatccaaaacaaggcctgtaggtaaaaccatcgaaaacgatgattactatggtaaaagatcttctacaggttcatcgctcaaacaactcttcaataaaattaatattaatgataccgctcactcttcaaacaaagaaaatgtatctcagtcggtgctatcggaaaacaagctgctctctccatctaaaaggttgtcgaagcaaggtcttacaaaggtgactaactccaagtttcgtacacccttgagacctatttcaaaccaatcgactttatcaagggatgagcctgttaaagattttagatcacttaagtttcggagcggtagtgatttcaaatgctggggtgacgagaagacaagttctcatgttcattcatccagtgtgaactcagttaattcctttacttctaccacctcttcttcaaagtggaagttctggaaaaatgataacctattgtcgaggtcgctatcttccagatctgtgaatgaccaagatccgaactttgttcagccaaaaccaaccaattcgttacaaaagaagtcttcaatttcaagttttcacaattctatttttggtggtggcaaacacacagagaagaagaggaattctggatttattatgcccgatcatcagagcacgaaggagctaaaccacaaacattcatcatcgaacctttcctttagaagtttgaagcataaaacatcacattcttcactaaataagctcaaagtaaggcgtaaaggaaatacacaagaactgaatcatccgatcaaaaaaacttgccaaatatcattgcctgttccagaccaagtctcaaaggacaagattcaactgaaattgaaaaattcaacatcattggcatccttatcttcagaagtcactcccataaacactttggactacaatgattcaattttgcaacaaatattacaactttgtgatgttaagtatatattacatgatctacgtgaagctcagtcattaggcttgtttacgttgaatactagatcggttcagctgtctcataacttttggcaaacttatcatagcgatatgcaaacttcactcatttgcaagaaagtatgtctaggggctctaagtgatttgactacttcaaacttgatatccttacatgaattgaaatcattacggttaatacaaggaactagcggtgtcgccaatttactgcaagcttatgttgtgccctcaaatcaatgtgaaaatgaccaaaacttgatactgtacttatttttcaaataccagggaactcctctatcaaggtgctctaacattgattactctcaagcattgtctattttctggcagtgcagcagtattttatatgttgctgaatccaaatttcagctcgaacacaggaatctaactttggaccatattttgatagactctaaagggaatgttactttaattgatatgaagtgctgtcgtttcttgaatatagacaacaataaggcttcctatacaagattagaccatcattatttcttccaaggccgggggactcttcaattcgagatatatgaactgatgagaagcatgctgcctcagccaatatcctgggctacatttgaaccaagaacaaacctattatggttatatcacctaagtagcagcctgctaaaaatggccaaaaaagccgtagtcagcggcgctttgaaccgggaagaaaatatcttaatcgagttgacgcacttactcgatcctgctcgaaaacattccaaaacaattttcaaaaaggaacttgttataagaacttgcggtgatttgttatctttgaagggagaaataatgcagtaaagacatcgtagtaataaggtgcaagcttttgtatccttcttaatgatttgtaagcaaaaaaaaattacgtacatcaatttgtaatggaaaggaaataaatagtataatatgaacactctttctgagaacagttatctttagcttgccccacaaactgaaagcacatttttaaaatgttttacagatgaaaatgaacccttgtactgttatcctctgtaagtcgttatttttcttttgcctttttcaggttgactgctactgtaatcgtaagaatattcaaaatcaatcatctcgcatcgcaacaaaaataaaacgaagttactggtttaggtggcagaaacatataatattggcgaacattcataaaataattaaggcttaccaacgaagcataataaaattgccagtaaccaaaggtctctgataacatgaaagtggtaaagtttccatggttggctcaccgtgaagaatcgcgaaaatatgaaatatacacagtcgatgttagccacgatgggaaaaggttggccacaggcggcctagatggcaagattaggatatggtccatagattccattttgcgttgcatggaactagaatctctaactcctgagatacctcttccgcaagacttgcagatgccgttatgtagcatgagtaggcataccggctcgataacatgtgtcaaattctcaccggatggaaagtaccttgcaagtggatccgatgatcgaattttactgatatgggctcttgacgaggagcaaagctcacaacccgcctttggttctgagcatgagagagagcattggacagttcgtaaaagattggttgcacacgataacgacatacaagacatttgctgggcgccagactccagcatactagtgacagttggtttagatagatctgtcatagtctggaacggttctacatttgaaaaactgaagagatttgacgtacatcaatcacttgttaagggcgttgtttttgatcccgctaataagtattttgcgactacatctgatgatagaaccatgaagatatttagatatcacaagacgggggatatttcttttacaatagagcatataatcaccgagccattcaaagaatcacccttgactacttattttagaaggccatcgtggtctcccgatgggcaacatattgcagttccgaacgccactaatgggcccgtaagttctatggcaattgtaaatagaggaacttgggatacaaatgttagtttaattggtcatgatgcacctacagaagtcgcaaggtttaatcctagattgtttgagagaaatgcgggtgtcaagcaaaaaaaagacgatgacccagaaaatgctctagtggggcaaaacgatgataaagttcaccattttgataaaaacatcgactctgttgtggcaacagctgggcaagataaatccttagcggtctggagtacaagtagaccaaggccaatattagttgctttcgatatcgcaaataaatcaattactgatatgtcttggaatccagacggctctttattatttgttgcgtcattagactcttcaatcaccttgtttaaattcgaaaataatgaactaggcaagccaattcctttggaaaaaaatatggagcagttatataggtacggtgttgacaaggactcattagatttccctgaaagtatcaaccaactgttactcgaagatcagacaaaatcatttaagcatacaaaaatttcaacatcgaaactaggtgaaaaccacccgacacttgcaacaaattcagcttcaaatcaaaaagataacaatgatgcttctgtctctagaagtgaacatataaatatcttgattccaaagaggaaaaaggatgctatactgaataaagccgtaactcttaaaagcggtaaaaagcgtgtggcaccgacattgatatcgacttcatcatcttctcccttttctaatggaatcaaaaagcctacattggatagtaaaaggattgaaaataatgtaaaatcatccaccaagaccattaacagtaaaaatacattgctaaatgtgccagaaggcgttgaaaagaaaattagtatctcatcgttcccattgccaaggttgggcatacattctttgattatgggtacaaaagaaaggagtgcatggaaaatctcaaattcagagctggagaatgatgatgcagataatgcgggtggtaagggttcagatggtacgagcaacagtattgacgacattgcagttctctcagaggaagaaaatgactttcataggatgactttgaacgccaagctaacccaggagaagatctggagcgaagagccgacaacacgatgccttctgcagtccgatgtcataccagacacagatgttgtcgttcttgaggggggtagtttagacgatatagccgttttagaaataagaaacggtgttgagagatcaatacaatttgattctgaagcacttttagataatcctaccagaatcttaggctatcaaggaggtaaaagaaccatcgagacctttattccagaagttatcatttgtgcaataggatcaaaagattgtaagtgctggtgcctagcttcagctaatggctctatttacatactttcatacaatggacagcagagaatcccaaaaatttgcctaggacataaagttattaaaatggtaacatcaagcaaatacctccttgttctaactgaaagaggtttattttttgcatgggacttgctggatttaaaattagtactgcgaaatgtacctatattaccaattttgaacggtcagccaattcatggaaacaaggtaagaatcaacaaggttattaaatgctttcgtttggatggttctagttgtgatttgcttttagaggttggcgatcctaaaaatgtgtataaatggactaaggatctgggttgttggtcgttatataaataataagcttataccccttcctttggacaagttttttccctcataattacgtctatattttataaatatcattgtagtattcgcattgtttaagtggttaccatttgaaacgactcatacagacaagcggttacagatgaagctttctgaaggcacagatcagaagtattttaatgtcggttgtctattagtggaaccaaagtgactacacacctcctctgtctggaagaaataaattcttagggtcgactccaccatttcaactttagtataatatgacaataaaacattattgggactgagaacgattatattaaaattagtaaaatacatacataactacttataaaaaaaaaaagagaaatttgccattttcacgagtataagcacagattgtacgaaactatttcatatagcttgttttagttattatcctataaaatcttaaaatacattaatctagaatccaaacggatttgatgcagtagcattgaatatgttggcttgccttgattgttgaggtccattaccaaacccaaatccagtaggttggttctgtaatgcttgttgttgtggttgttgcatagcacccccagtgttaaaagtgttcatcatctgtggttgttgcataattccatcggtgttgaatgtgttcatcatctgtggttgttgcatagcaccaccagtattgaaagtagtcatcatttggagctcttgcataacaccaccagtattgaaggtattcatcgtttgtggttgctgttgttgaagaacgccccctgtacttaaagtattcatggctccaccagtgaactggttctggtttaatggcgcaatacctccggttttttgtaaagtcaaaccgaattgggattgcggccggaacccgccagtgttttgagcttgagagctgaacgaagtctggggaatcatggcgcctccagtattaaatgtattcaaagcaccaccagttctctgcaaaggcatcattgctccccctgtaacttgtggtaaagcattgaaggacgtttgaggcatcattgctcctccagtaatttgtggtacagcattgaaggatgtttgaggcatcatggcactccctgtattttgaggttgggtcatcattgcaccacctgttaattgctgtgaaacgccaaatgatgtttgtggaatcatagtgccgcctgttctttgtacagttggcattgagacaccagtattagctgaaattaatccattagcagttttttggacaggtaatattgaacctgttggaagttgttgttgcccctgaacattgaatgaagtttgcgggaattgcgcacctcctgtggtggcaattggtattaggccacctccagttttttgcagaggtaagacggtagctgctgcgccgaacgtagtttgtggcatcattgcgccgccagtgttagagataggaattaacccatttcctgtcttttgaacaggtaggataccaccagtaacttgcgattgcataccaaaagttgtttgtggtacaacgaagccgccggttctttgcataggcagcatatcgcccccagtaatcattggcatcatcacaaagccagtagataagggtaagatattgttgccaccggttttgaatggatccaatggagcgggagcagatgaaaccggagcagatgaaaccggagcagcaggaacagtggtgccgccagttttcacgggttccaaatcttttaggtttggttcaggtgtcgaggcagctgcctttttaggttctaaaggttgcaagtctaataaatcctgcatggaaccagtaaattctgatttcttagagagtaaattagattcagacttagaagccggtttaacagtccaagcatcatctgtctcagctgatgtggaaggagctgtttgagcaggacttgttgtttgtggcaacaattgctgaggcagtgaggtttccggacttgtagcaacgttcaatgaaccatcaggttgtgaaaacatatttccagtggcatttgtaggaattgatgcaatattttctcttccaaatttcttgtcaagatgtttcattactctaacaatatcaccttcgcgcagacccaaggttcttaacattgagttattgatgtcaggcatcatgtcttcagtaagctgttctctatcaaaatttattgtatatctttgacaattgcttacatcaacgccgcaattcaagaaaaattcgaaccaatcatatttgttactggagttgttgttattgctgctttcggctggtggtacggacgtcgtatttggaacggaggtagtagaggttggtcttggtggttttattggaggcaattccttttcttgcaaccttgatctttcttcatctaggagttctctggcttttttcaattcgtataattcacgctctttcaatctcctatcgcgttctttttcctcctgctccttcaatctccttcttctttctctttcagagtctcttgaatcagtgccacgggaactagacccatcattcgccttaaatttctctaaggagaacccagtaattttttccacatacgctaaatcttcattggatagtttatcagcggcgacagcaatcttgacaccattagccttgtgcaagtggattttccccttagcacatccaatgaattctgcatccactttgaaagtaccacttctatcaacccatagacgcgatttttttggattggggaaatctttggtcgccgaagagttttttttgtgagaggacaatgaactttttcttgaccttttaccggcagcactacctacaacatcgttttgtagttcatcatctttccaactggcattggcattggatttagatcttgatctagatctcgacctagatggagatttggtgaagtttttcttgatagacttgatgataccgcttgctgtagattcagtatgttttttgtcacgaacaggctcaataaactgtgcaggaacgagaccgcttttccctgaatcaaccagttggcacatccaccagtccttagattttttatcatctaaaatgtagactttatcgcctgattttatggttaattcgtcctgtgattcagccatgaagtcatattgaacaatacctctctttttggatttggaagccatttcgacttctctcaacccaggatcacgggaagcacctttatattcaccaataatgttcatgatctcttcacatgtggtggtattaccagtgtgtaattcaaggcttctatatggatcaacaaattccaagaacatgtgtttcttttcgttatcataagagaccaatttatcaattgaccactcatgaggagtccccttttggggtatgaagtttatcttgttgttaccgattgatagcttggccttcttctttttccttccctcgatttcggtaacgttccaagagtgatactctgtattgtattcgtgatttccaacgttgttgctgttgctgttgtaatagtaatcatcctcttcatcgtcattatcgttatcgctgtatgatagtcttgtacgagatcgaacagccgcagcggtggcatcagtagtttcggtagtagccgttggtcttgcaggcatggcaggaggagggccctcttcatcctcatctggagcttggtcttctttactttgcatcatacgagctctatcattgtgttgaggaggtggtaaaaagttggtgggtagtacggcagcagaagcaggagcggctgcaggagtagctgcaggagcttcagcggcagcgggagcctgttcctgcttggaagtggacccattctctggttcgacgtaattgcctggaatgaagccgaattcattggaaacggtagacttaaccaacagccaatcagcatctttatcatcgaatacatcaaaaacgtcattttcatgaaacgtcaattcttcatcagcattttgcacctgttcataatcataaatggctcttaccttcttcaaaacaggagcttcttcaatgtaagtggagggcactagacccaccggttcttcgctatcggaaccaatgactcttttctttactgtccaccaatcgtcaatgtctgacttctgtaagaggtacaacagatcgtcttcttggatggccagttcttctggtgtctgcggctcataggcatagacggccctatagatgcccagaaacacagtcatactctagctcttttgtatataacacactctgtcgccttggctatgttacactatcccttcttttaggattgcaatagatatacatagtatatatgcgctaaatattcgttctgttttcgtctgatgtatctcgatttcgcatgagtggaaggaagccccttttaggaatcgtatagtcactttctacgaagcaacattctacctctatcaattacatggtttaatctacgcaggcatgttctctaagttgagaccgcctatgggaacctataaatcgtgattgacaccgtttgcatattatcacttttcttttccttttagcctcgctattcctggggctctctatgtgtgattggaagggtagagacaattgtcctgcgccggcaagaaaaacatcgtgtgtctctagagcagctttgcattctaatgtgcggtggaaatggtgcgaaaaggtcgacacttgacagggcttccaactgctggcgtggcacataactgcccagcagtgaatggcctacttcatactccacctgtgccgcatcggcgagcgacactttaccgcctaggtaaccatgtacagctactcttttgggcttggataccttcgctttactattctcactgccctctatgcccttgtcggtagcatgagattgttgcgtaagctgttgaagctcagtcgcactgaacactacctgggatgacttttccagcgctgaaagccctgcgagtacgtcatagtatcccatattacttccactcattctcagctattccttgttaacaccgtgctctgctgctttcaggtaaagccattatttccacgacaactgcatttcacttttcattttcttccagaacaacaggcgctgcccttgtttccgcggagctgcctcctctgccgctcggactttccgcggaataataaatgaactatcacagtgagtcttagaatgcaaatatgtagatactgttatagaatctcattaatgtatttatgtatttcctgtgtttgtgtcttcaggagccttccaaagcaaccataggtcttaggcgacaactgcatcagcagttttattaattttttcttattgcgtgaccgcaatgaaagtgaagaaatcaactagatcaaaagtttcgacagcatgtgtcaattgcagaaaaaggaaaatcaaatgcacaggtaaatatccatgtaccaactgcatttcttacgattgtacgtgtgtattcctaaaaaaacatttaccgcagaaggaggatagttcccagtctttgcctactacagctgttgctccaccctcttcccacgccaatgtagaggcttcagcagatgtacagcatctggacactgcgattaagctagataatcaatattacttcaaactgatgaacgacctgatacagactccagtctctccgagtgcgacgcatgctcctgatacttccaataatcctactaatgataataatattctctttaaagatgattccaaatatcaaaatcaactggttacgtatcaaaatattctgacaaatttgtacgctctgccgccttgtgatgacactcagctcttgattgataaaacgaagtcgcagttgaataacctgattaacagttggaatcccgaaataaactaccccaagctttccagtttctctcctcgcccacaaagatcgatagaaacgtatcttttaaccaacaagtatagaaataaaatacacatgacgaggttctccttttggacagaccaaatggttaaatcacaaagtccagattcatttctagccaccactccactagtagatgaagtatttggtcttttctctccaatacaggctttttcactaagaggtataggatatttaattaaaaaaaatatcgaaaacacgggttcatcgatgttaatagatacaaaggaaactatttatctaatattaagattgtttgatttgtgttatgaacatttgatccaaggttgcatctctatttctaatccattagagaactatcttcaaaaaataaagcaaactcctactacgacggcatctgctagtttgcctacttccccagcacctttatctaacgatttagtcatttctgttattcatcaactacctcagccatttatacaatcgattaccgggtttacgactactcaattgatagaaaatttacatgattcattttcgatgtttcgaatagttactcaaatgtatgctcaacataggaagcgctttgcggaatttttaaaccaagctttctccttgccccatcaagaaaagagtgttttattctcgtcattctgctcatcagaatatcttctatctactctttgttacgcatactacaatgttaccctatatcacatgttggacataaacactttagattacctagagattttagtgtcattgctagaaatccaaaatgaaattgatgagcgttttggatttgaaaaaatgctagaagttgcggttacatgctccactaagatgggattgtctcgttgggagtattatgttggaatagacgaaaatactgccgaacggagaagaaaaatatggtggaaaatatacagtctggaaaagcgttttttaactgatcttggtgatttatccttaataaatgaacatcaaatgaattgtctcttgccgaaggatttcagggacatgggattcattaaccataaagaatttttaacgaaaattggtacgtcctctttatcaccgtcatcgcccaagctaaaaaacttgtcattgtccaggcttattgaatatggtgagttagcgatagcccaaattgttggagattttttttcagagactctttataatgagaaattcacgtctttagaagtatccgttaaacccacaattatcagacaaaagttattggagaaagtttttgaggacattgaatcttttaggttaaaattggccaaaataaagcttcacacctcaagagtttttcaagtagctcactgcaaatatccagaatatccaaaaaacgatctaattgaagcagctaaatttgtaagttaccataaaaatacatggttctccatcttgggtgctgttaacaatcttattgctaggctatctgaagatccagaggtgataactgagcaaagcatgaaatatgcgaatgaaatgtttcaagaatggagggaaattaatcaattcttaatacaggttgatactgattttattgtttgggcatgtttggacttttatgaactgatatttttcgtgatggcttcaaaattttatgtggaagacccgcacatcactttagaggatgttatcaacactttgaaagtttttaagagaataactaacattatttctttttttaataataatttggacgagaaggattatgattgtcaaactttcagggagttttcgagaagttcgagtttggttgccatatccataagaatcatatttttaaaatactgctatgccgaacaaattgatagagccgaattcatcgaacgtttgaaagaagttgaaccgggtctaagtgaccttttgcgtgagttttttgatacccgctcttttatttacaggtacatgttgaaatccgttgaaaaatcaggctttcatttaataattagaaaaatgttagaaagcgactataaatttttgtatagagacaaattggccactggtaatattccagaccaaggaaattcaagccaaatttctcagttgtatgacagtactgctccttcatacaacaatgcttctgcctcagcagcaaactcaccgttgaagttatcgtctttgttgaactctggagaggaatcgtacactcaagacgcatcagaaaatgttccatgtaatctgcggcatcaagatcgatcgttacaacagacaaaaagacaacattctgcgcctagccaaataagcgctaatgagaataatatatacaacttgggtactttagaggagtttgtcagcagtggtgacctgactgatttatatcatactctgtggaatgacaatacttcatatcccttcttatgaaaacgcaaaagaaatagggaagcagagcataaccatagtaaatgggacacttataactcaagaatttaattgaccccctactcatactgaggaatgtggcgtcctcgtcattatatgttcgtaagctaattgggcgaaactttagtctgtcctttctgttcggtcttcacataagatcaacgatttcttcattaattttgggcgcgctgttcaaaaaggtcctggaatgcagctgttcagtagatattatatgtaattatagcctcaacaatttttcttggatcgattggatgagctattcacccatagaggctggattttccttagtttgagaatctgcgactccttcgcgtctgacatcggtcactacgctttctctattctgctgccgttgcgttactttgataaattcatttctttttttttgtaatacagaagaatttctggtaagtttttggcctgtgcgtgttcataagggaaagacattgcgcatataggaaaatgttagaagttcaacatcgataaaatgatattgtgtagaaacaccgattcccttttgtagatttctatatctttgggtatgacttctagtattatctgtatatctaatattatagtctctaacaacagtggaattgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatccttgaggagaacttctagtgtatattctgtatacctaatattatagcctttatcaacaatggaatcccaacaattatctcaacattccccgatttttcatggtagcgcctgtgcttcggttacttctaaagaagtccaaacaactcaagatccgttagacatttcagcttccaaaacagaagaatgtgagaaggtttccactcaggctaattctcaacagccaacaacacctccctcatctgctgttccagagaaccatcatcatgcctctcctcaagctgctcaagtaccattgccacaaaatgggccgtacccacagcagcgcatgatgaatacccaacaagccaatatttctggctggccagtatacgggcacccatccttgatgccgtatccaccttatcaaatgtcacctatgtacgctccacctggggcacaatcacagtttacacaatatccacaatatgttggaacacatttgaacaccccgtcacctgagtcaggtaattcatttcctgattcatcctcagcaaagtctaatatgacatccactaatcaacatgtcagaccaccgccaatcttaacctcacctaatgactttctaaattgggttaaaatatacatcaaatttttacaaaattcgaatctcggtgatattattccgacagcaacaagaaaagccgtacgtcagatgactgatgacgaactcaccttcttatgtcacacctttcaactatttgctccatctcaattcttacccccctgggttaaagacatcttatctgttgattatacagatatcatgaaaattctttccaaaagcattaacaaaatgcagtctgatactcaagaggtaaatgacattacgaccctagcaactttgcattataatggaagtacacctgcagatgcatttgaagcagaagtcacaaacattcttgacagactaaacaacaatggcattcctatcaataacaaggtagcatgccaattcattatgagaggtctatctggcgagtacaaatttttaccgtacgcacgtcatcgatgtatacatatgacagttgctgatctgttttcagacatacattctatgtatgaagaacaacaggaatcaaaacgtaataaatctacttataggagaagtccgagtgatgagaagaaagactctcgcacctatacgaatacaaccaaacccaaatccataactcggaattcccaaaaaccaaataattcgcaatcaagaacagccagggctcataacgtatccacatttaataactctcccggccctgataacgatctcataagaggatcgactactgaaccgattcaattgaagaatacacacgaccttcaccttaggccaggaacttactgaatctacggtaaatcacactaatcattctgatgatgaactccctggacacctccttcttgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcaataaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcacatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctaaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggaatccagattagatcaattcaattacgacgcactcactttcgatgaagacttaaaccgtttaactgcttcatatcaatcgttcattgcgtcaaatgagatccaacaatccaatgatcttaacatagaatcagaccatgactttcaatctgatattgaactatatcctgagcaaccgagaaatgtcctttcaaaagctgtgagtccaaccgattccacacccccgtcaactcatactgaagattcgaaacgtgtttctaaaaccaatattcgcgcacccagagaagttgaccccaacatatctgaatctaatattcttccatctaagaagagatctagcaccccccaaatttccgatatcgagagtaccgattcgggtggtatgcatagattagatgttcctttacttgctcccatgtcccaatctaacacacatgagtcgtcgtacgccagtaaatctaaagatttcagacactcagactcgtacagtgacaatgagactaatcatacaaacgtaccaatatccagtacgggtggtaccaataataaaactgttccgcagacaagcgaacaggagactgagaaaaggattatacaccgttcaccttcgatcgatacttcctcatcagaaagtaattcactacaccacgtcgttcctatcaaaacgtcagatacctgtcctaaggagaatacagaggaatctataattgctgatcttccacttcccgatctgcctccagaacctcctaccgaattatcagactcctttaaggaacttccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacgaacaaccttacgatacgatgaggcaatcacctataataaagatattaaagaaaaagaaaaatatatcgaggcataccacaaagaagtcaatcaactgttgaagatgaaaacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactaccatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacaatgtggtatggaagaagttcgtggatggtcatgcgtatttaaaaacagtcaagtgacaatttgtttattcgtagatgatatggtattgtttagcaaaaatctaaattcaaacaaaagaattatagacaagcttaagatgcaatacgacaccaagattataaatctaggcgaaagtgatgaggaaattcaatatgacattcttggcttggaaatcaaataccaaagaggtaaatacatgaaattgggtatggaaaactcattaactgaaaaaatacccaaactaaacgtacctttgaacccaaaaggaaggaaacttagcgctccaggtcaaccaggtctatatatagaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggtaaccaaccgtattataaatcacaaattggcaacatatatttacttaatggaaaagtaattggaggaaagtccaccaaggcttcattaacatgtacttcaaccacggaagcagaaatacacgcaataagtgaatctgtcccattattaaataatctaagttacctgatacaagaactcgacaagaaaccaattaccaaaggattactaaccgacagtaaatctacaatcagtataattatatccaataatgaagagaaatttagaaacagattttttggtactaaagcaatgagactgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatccttgaggagaacttctagtatattctgtatacctaatattatagcctttatcaacaatggaatcccaacaattatctcaacattcccccatttctcaggaatcccaacagttatgacaaaatttatcagaattcccagtttcatacatgtttgatatttatagataattcataatgacggtttatttattctggtaagttatgatatcatgtaaaacgaggcaacttggccgagtggttaaggcgaaagattagaaatcttttgggctttgcccgcgcaggttcgagtcctgcagttgtcgttattttttggacagtaataagagtacgtaaagtcaatggaatacgtggtaaaagcatcacgtttatgttttattaaaagattggcatagaacttggccttcttcgtaacgacttatcacccgttaaaagtatgctatatgagttatatcggctgcagtgtatttcttcctggctcatttaaagctaatgaaatgtacctctcgcttcattttctaaggtagtgttttgaaggcgtatgtatgtaatgtcacccggacttttgtaaagaaaaaattttgagtttatgtctttccgaaaatttttaccgatgagcattgaaaagttgcattattaaatttggtagcgtaaaaaccaccgattaaacaggtagtgtaggttgtaaattaaagatcatattctttcctgtttacatccagttttacgttgttggccgtattggtatatttctagtatcagttacacatatttcattgaaagtatggctaaacaaagacaaactactaaatcgtctaagcgatatagatattcttccttcaaggctaggattgacgatttgaagattgaaccggctagaaatttggaaaaaagggtacatgattatgtcgagtcgtcgcattttctcgcttcctttgatcagtggaaagaaattaatttaagtgccaaatttacggagtttgcagcggaaattgagcatgatgttcaaacattaccccaaatactatatcatgataaaaagatttttaattctttggtttcattcattaactttcacgatgagttttctttgcaaccgcttctggacctcttggctcaattttgtcatgatttaggtccagattttcttaaattttatgaagaagctatcaaaactttaataaatctgttagacgctgctatagaatttgagtcatctaatgtttttgagtggggtttcaactgtttggcttatattttcaagtatctctcgaaatttttggttaaaaaactggtactcacatgtgatcttttaattccactattgtctcattctaaggaatatctttcaagattttcagcagaagcattatcttttttagtaagaaagtgtcctgtttctaacttgcgcgagtttgttagatcagtttttgaaaagttagagggagatgatgagcaaactaacctctacgaagggcttctgatattattcacagaatccatgacgtcaacgcaagaaactctgcattcgaaagctaaagctatcatgagcgttcttttgcatgaagctttgaccaaatcatccccggaaagatctgtttcattgctctcagatatttggatgaacattagtaagtacgcctcaatcgaaagtttacttccagtctatgaagttatgtatcaggattttaacgattctctcgatgccaccaatatcgatagaatattaaaagtattgacaacaattgtcttctcggaaagtggtagaaaaattcctgattggaataaaattactatcctaattgaaagaataatgagtcaaagtgaaaattgtgcttcgctttcacaggataaagtggctttcctatttgctttatttattcgtaacagtgacgtgaaaactttaacattattccaccaaaaactttttaactacgctttaacaaatatatctgactgtttccttgaattctttcaatttgctttaaggctaagctatgaaagagtattttcattcaatggattaaaattcctacagttatttttaaagaaaaattggcaatcacaaggaaaaaaaattgcacttttttttctagaagtagatgataagcctgaactgcagaaagtacgggaagtaaatttcccagaagaatttattttatctatcagagatttttttgtcacagcagaaattaatgattcgaatgaccttttcgaaatatattggcgagctataatttttaaatattcgaaattacagaatacagaaattattatcccattgcttgaacgtatcttttcaacttttgcatcaccagataattttacgaaagatatggtcggtacactcttaaaaatatatcgtaaagaagacgacgcttcagggaataatctattaaagactattctggataattacgaaaactataaagaaagtttaaactttttaagaggatggaacaagttagtgagtaatcttcatccttcagaaagcttaaaaggactaatgtcacactatccaagtctactccttagcttgacagataattttatgttgcctgatgggaagattcgttatgaaactttagaattaatgaagacattaatgattttgcagggtatgcaagtacctgacctcctttcttcatgtatggttatcgaggaaatacctcttacactacaaaatgccagagatttaaccattagaatcaagaatgttggtgccgaattcggaaaaaccaaaacagacaagctagtatcctctttctttctcaaatacttatttggccttcttaccgttagattctctccagtttggactggtgtttttgacactcttcctaatgtttacacaaaagatgaagccctcgtttggaaacttgtgctatcattcattaaacttcctgatgaaaatcaaaatttggattactaccagcctcttcttgaagatggtgcaaacaaagttctgtgggattcgagtgtagtgaggttaagggacactattgatacgttctcacatatttggtcaaagtattctactcaaaatacgagcattatatctactactattgaaagaagggggaacaccacctacccaattttaattagaaatcaggctctaaaagttatgctatcgattcctcaagttgctgaaaatcacttcgtcgacatcgcaccttttgtttataatgacttcaagacttacaaagatgaagaggatatggaaaatgaacgtgttattactggttcatggacagaagttgatagaaacgtgtttttaaagactttaagcaagttcaaaaatataaagaatgtttatagtgcaacagaattgcacgatcatctgatggtactgttgggtagccgtaatacagacgttcagaagcttgcgttggacgcacttcttgcatacaaaaatccaacgttgaataaatatagagataatttgaaaaatctactagatgacaccttattcaaggacgagattacgacttttttaaccgaaaatgggtcgcagtctatcaaggctgaggacgaaaaggtagtcatgccttatgtccttagaattttcttcggtcgagcacaagtccccccaactagtggacagaaaagaagccgcaaaatagctgtcatttcagttttgccaaattttaagaagccatatattaatgattttttgagtttggctagtgaaaggctggattataattatttttttgggaacagccatcaaataaatagctcaaaggctaccttgaaaactatcagacggatgactggtttcgttaacattgtaaattctactctgtctgtattaagaacaaattttcctttgcatactaattcagtgctgcagccgttgatctattcaattgctatggcatactatgtcttagatactgagagcacagaggaggtacatttaagaaagatggcaagtaatttaaggcaacaaggtctaaaatgtttaagtagtgtctttgaatttgttggaaatacatttgattggtctacttctatggaagatatttacgccgttgtagttaagcctcgtatttcacatttttcggatgaaaacttacaacaaccctcctctttactaagacttttcctttattgggcacacaatccatctctgtaccagtttttgtattacgatgaatttgcaactgccactgcattgatggacaccatatcaaaccaacacgttaaggaagctgttattggcccaataattgaagcggcggactcaattattagaaatccagtaaatgatgatcactacgtagatttggtgactctcatctgcacatcatgtctgaaaatacttccttcgctatatgtcaaactttctgactcaaactcgatttccacatttttgaatttgctagttagtatcactgagatgggatttattcaagatgatcatgttagaagtcgtttaattagttcattaatatcaatattaaaaggaaagctaaaaaaactgcaggaaaatgatacccaaaaaattttgaaaatattaaagctgatagttttcaactacaattgttcttggagtgatattgaagaactatacactaccatatcttctttgttcaaaacatttgacgagcgaaacctcagggtttccttgacagagctcttcatagaactcggtagaaaagttcctgaattagaaagtatttcgaaattggttgcggacttgaattcatactcctcatcacgtatgcatgaatatgattttcctagaattttatcaactttcaaggggttaattgaagatggttataagtcctacagtgagttagagtggttacctctgttgttcacctttttacattttatcaataataaggaagaacttgcgttaagaacaaacgcatcccacgctataatgaagtttattgacttcattaacgaaaagcctaatcttaatgaagcttcaaaatcgatttctatgctgaaggatatacttttacccaatataaggattggcctcagagactccctagaagaggtacaaagtgagtatgtatcagtgctatcatatatggtaaaaaacacgaaatatttcaccgacttcgaagatatggccattttactgtacaatggtgatgaagaagcagatttttttacaaacgttaatcatattcagcttcatcgtcgtcagagagccattaaaagactaggtgaacatgctcatcaactcaaagataacagtatatcccattatttaattccaatgatcgaacattatgtcttttcggatgatgaaagatacagaaatattggaaatgagacccaaatagccatcggagggttggcgcagcacatgagttggaatcaatacaaagctcttcttagaaggtacatttctatgttgaaaaccaagcctaaccaaatgaagcaagccgtacaattaattgttcaactttctgttccacttagagaaactcttcgtatcgtaagagatggggctgagtcgaaacttactttgagcaaatttccttccaacttagatgaacccagtaattttattaagcaagaattgtatccgactctttcgaaaattcttggcactagagatgacgaaactataattgaaagaatgcctattgcggaggcattagttaatattgttttagggctcacaaatgatgatattactaatttcctccctagtattctaacaaatatttgccaagttttgagaagtaaatccgaagaattaagagatgcagtaagagtaaccttgggtaaaatcagtattatcttgggcgctgagtatcttgtctttgtgataaaggaattaatggctacattaaaacgtggttctcaaattcatgtgttaagttacactgtccactacatattaaagagtatgcacggagtcttaaaacactccgatttggatacctcgtccagtatgattgttaagattataatggaaaatatctttgggttcgctggtgaagaaaaagactctgagaattatcatacaaaagtgaaagaaattaagagtaataaaagctatgatgctggtgaaattctcgcctcaaacatcagcctgacagaatttggaacattactctctcctgtgaaggctttgttgatggtcagaattaatctaagaaatcaaaacaaactgagtgaattattgagacgatatttgttgggtttaaatcataatagtgactctgagtcagaaagtatcctcaagttctgccatcagcttttccaggaatcagaaatgagtaattcccctcaaataccaaagaaaaaagtgaaagaccaagtagatgaaaaagaagactttttcttggtaaatttggagtcgaaatcttataccatcaactcaaacagtttgcttttgaacagcactttacaaaaatttgctttagacttacttaggaacgtaataacgagacaccgctcctttttaactgtctcgcacctagagggttttattccatttttgagagattcgttactttcggaaaatgaaggtgtggtaattagtactttacgtatcctgattacattaattaggctagatttttccgatgaatctagtgaaatcttcaaaaactgtgcgaggaaggtactaaatattatcaaggtttctccttcaacttcaagcgaattatgccaaatgggtttaaagtttctttctgcctttatacgtcacacagattcaacattaaaggatactgctttgagttatgttctagggagggtcttaccagatttaaatgaaccaagcagacaaggccttgcttttaatttcctaaaagcacttgtttcaaaacatatcatgcttccagaactctatgacattgcggatactactagggaaatcatggtcacaaaccactcaaaagaaattagggatgtatccaggagcgtttactaccaatttttaatggaatatgaccaaagtaagggtcgtttagaaaagcagttcaaatttatggtcgacaatttacagtatcctaccgagtccggccgtcagtccgtaatggaattgatcaatttgattattacaaaggctaatcctgctttactatccaaattatcatcttccttctttctggcgctagttaatgtttcttttaatgatgatgcgccaagatgccgtgagatggcttcagtattgatttccaccatgcttccaaagcttgaaaataaggaccttgaaattgttgaaaaatatatagccgcttggctaaaacaggttgataatgcatcctttttaaatcttgggttgagaacttataaggtctacttgaaaagtattgggtttgaacatactattgagctagacgagcttgccatcaagcgtataaggtacattttgagcgatacgtcggtaggatcagaacatcagtgggatttggtatactcagctttaaatacgttctcatcttatatggaagcaacagagagcgtttataaacatggtttcaaagacatatgggatggtattatcacatgtctcttgtatccgcactcatgggtccgtcaatcggcggcaaatcttgttcatcaactcatagccaataaggataagctggagatatcattaaccaatctggaaattcaaaccattgcaacaagaattcttcaccaattaggtgcgccttctattccggagaatcttgcgaacgtctcaataaaaacattagttaatatcagtatcctatggaaggagcaacgcacgccgttcataatggatgtatcaaaacaaactggagaggatctaaaatatactaccgccattgattatatggtaactcgaattggtggtattatcaggtcggatgaacatcgtatggattcttttatgtcgaagaaggcgtgtattcagttattggccttattagttcaagttctggacgaagacgaagtaattgcagaaggggaaaagatattattgccgctatatggttatttagaaacatattactcaagagcagttgatgaagaacaggaagaactacgcactctttcaaacgaatgtttaaaaatactggaagacaaattgcaagtatccgattttacaaaaatatacactgctgtcaaacagaccgtattagaaagcagaaaggaaaggagatctaaaagggcaattctggctgttaacgctccacaaatttctgctgataaaaagttgagaaagcatgcgagatcgagggaaaagagaaagcatgaaaaggatgaaaatgggtattatcaaagacgtaacaaaagaaagagagcctagctgtaatatatctttataacatgtatactaatgaataaaaaatccaagttataacgtcaaagctgtagtacgttagcatttccgtaagtaaaaccgtaaacttgatacgttttttattttctttattaatagtaatactatacactgtctttaataaaacgacgctatttataaaactgttagataaaagacataccagtcttcctcatatgacctactttaaaaccccaaatgacaagaatgtttgatttgctttgtttcttttcaactcagttcttacagttcttgagaagctttggcagtcttggcagacttctttggcaacaagttttggtgaatgtttggcaaaacaccaccttgggcgatggtaacattacccaatagcttgttcaattcatcatcatttctgatggccaattgtaaatgtcttggaataattctggtttttttgttatctctagcagcattaccagccaattctaaaatttcagcagccaaatattctaagacagcagttagatagactggagcaccagaaccaattctctgggcgtagttacctcttcttagcaatctgtgcactctaccaactgggaatgttaaaccagctttagcagatctagattgagaagctttagcagctgaaccagctttaccacctttaccaccggacattatatattaaatttgctcttgttctgtactttcctaattcttatgtaaaaagacaagaatttatgatactatttaataacaaaaaactacctaagaaaagcatcatgcagtcgaaattgaaatcgaaaagtaaaactttaacggaacatgtttgaaattctaagaaagcatacatcttcatcccttatatatagagttatgtttgatattagtagtcatgttgtaatctctggcctaagtatacgtaacgaaaatggtagcacgtcgcgtttatggcccccaggttaatgtgttctctgaaattcgcatcactttgagaaataatgggaacaccttacgcgtgagctgtgcccaccgcttcgcctaataaagcggtgttctcaaaatttctccccgttttcaggatcacgagcgccatctagttctggtaaaatcgcgcttacaagaacaaagaaaagaaacatcgcgtaatgcaacagtgagacacttgccgtcatatataaggttttggatcagtaaccgttatttgagcataacacaggtttttaaatatattattatatatcatggtatatgtgtaaaatttttttgctgactggttttgtttatttatttagctttttaaaaattttactttcttcttgttaattttttctgattgctctatactcaaaccaacaacaacttactctacaactaatgtcctctgccgccgaaaagaaaccagcttccaaagctccagctgaaaagaagccagctgccaagaaaacatcaacctccgtcgatggtaagaagagatctaaggttagaaaggagacctattcctcttatatttacaaagttttgaagcaaactcacccagacactggtatttcccagaagtctatgtctattttgaactctttcgttaacgatatctttgaaagaattgctactgaagcttctaaattggccgcttataacaagaaatccactatttctgctagagaaatccaaacagccgttagattgatcttacctggtgaattggctaaacatgccgtctccgaaggtactagggctgttaccaaatactcctcctctactcaagcctaagtcactcactaggtattgtgatttagtcatgttttctttttattagtggcattttttatatattgtaacattagggttctgttacttgtccagatatgattggaagggtctagtctatcagcctccgaaggagttgtataaatgtatatatataactttataaacaaaaaaaattgggaaagatattttgcaaacagttattattaaattgtttcttaaactctccttaaagatataccctatttaggttcactacacgagcattcattgagaaattttttttaaaacaacatcgatcttatcttgagcagtttggtgcttatcagttctagtcccaacacgaatatcagtgtgtactctaacatatcctttctcatgaccgtattcatggatttcgccaatcaaacccatcacatcatcccaaggcccttcaattgttgttcctgcactgtgtaaagtgctctttaatgggctttctctgatttttttttcaatgagtgcaacaaaatcagaaatactagcagagtcggtgccaatagggaccatacacacgtccgctaaacaaaagatcttgggcattttctaaacttgtagtttatgtgctttatagttaatgatcacgacggcaatgacaaaaactgaatatcttgatctctccttttgacgatgtcagtgaatcccggttaatgatattctgtttttcacggggtggaaaagaggggagcttgaatcatactaaaaaaggaatgtcaaagagctatataattcgaataaaaagtaaaagaaacgaaaggttttattaaagggtttggagctgttttcggactgaaagccagtaacaagcttgtgtaggagtttgtctgaaaaccatcttcatttcaaataagagagcgagtaatttttaaataatttcttttctgaactacttaaatcgctatgtaccttgcggaaattattctttaatagtttaactaaaagtaaaaagttagaaatcataaatagaaaatcaaagagacaaatctcgttgcaaaagcttgaaaaatagtgctttaccaacaggttggcaaaccagaatgctaacaaaacttaaaatcccatttcccaagaggatcaatcaatcatatttaccttgatagtataggatacaagtgtctgtgcaggcctccgataacatgtaaagtaataaaagtaggagtacttgctttcagcagaaaatgaaaaaaaggacgttcaaacagactggaaatatagctattcaactggcacctactaatatcaataataataaattaatcttgagcaaattgatcctacataaatcatgtgacttatttatttaattattattaagtaaaaaagattttctatttaaatttattaattaattttttttcttaaataattattttatgtttttgttttccgaaaaagaaaaatatttcaacaagaagtatcaatatatttcttgcaaaaaattgttcaccgagaattgacaaaaaaaccttacgtcggtgacgacgatatacagatcctatattcttcatgtatgtaatagattcccataccttcttcgcatttaagacactaatagaaatgaaagctttctattagtcattcttcctatgcactagaccacgcaaaggtgaaccggcttggtacgagaattctatcacacggtaatgatagtgttcccgatgtcaagcagtcttatacagtactacccaagagcttaagaataagcaagaagatctggcaagctacaaggtactcataacgatcttcaaagcgtaagttatgatcttatgaaaatcagacttttttgtctcaacaaactcctagtttgaagatgttactgaaatgcccttcaaacacttttacttgaaaatcatcgattactattctaaccttcacaaatgagcctttacacaacttgattaataataatatttgaccttactctaaatcgtctcaaatattactgaggcacaatctcatggttattgatagaaagaagaatataacatatatcttatttacatatgttcgtcaatattataggtaatacaattttttctcagagggtttcaaactattgaaaaatggcaatggtggactacaagcagcgagagcccttcttgcatgattattcatatatttcaatccgagcaaataacttgtgttcacccaaccaaagccttctgtagcgacgcccttaaaatcagcaccttgattaccatattccgcatcaacgcgatgcggatcagtccctcttgtcacatcatatttttctaccaccattccgttataatcaacaaatgattttgtaatcatgtacagccacctataagccaatcttgtagctacttgttgataaccatatgcagataaacctttccaggctaatatttggtgcggcgcccaaccaaaaggataatcccattgcctgatcggtctatcaatagaaataggacctcttgatttttctgtgcatgcaactagtccgccgagcatttctaactgaggaagagctttttctactgtgatttttgcttgctcttcagttgcaagaccagcccacaaactccaaaaagtcgttgcagactcataagacgttctgcatttcagtttcgtgttataatagaagaaaaaccctgaatcttcgtcccacatatacttattaatccttgttttcctcagttcagctagctcctcccagtgttcagaatcggttaccgttccatcattctcatctttatattcattaccaaaatactccttaatgacgaaagcaatatctttctcatatttatagagcaaggagtttagatcaattgtcgctaaatatgcacatacaccttcaaacctataagtcgtgtcatgtcctgactctctcacggcacgatcatgtaaaaaaaatgcatccagtttgggttctttaatcatgccttcgttataaaggtacctaagcttttccagagtaacattgtacttttcagcatacggtaataatatagtatcaaaatgatctggttcagtttccggagggataccaataccatcagaatgataacaagacagccctgtcagagaatctaacctagggctcgacatccacacctctttatattctttaatagcagctctgaacgcgcgttttaacaactgaatagcgtttggattattcttacctcctatcttttcaaatacgagcagagccatatcggttaggaatggtggctgagatctgcaaagataataactcctattagcattcaaaattttactatagtgatcaatttcgaatataaaatgctccaccatacctcttgcaacatcaaccttattactttctatgagtcccagtgccattaaatatgaatcccagccatacaattcattgaatctaccgccaggtaccgcataaggataaccaactagggacctttcaccagtagatggattaacgtgttcttccatagccagggctaacaaacccggtgtatcatttaatgatttaacatactctgctgtaatatcttttggtaagtactccacttcaagttttaaggacgggttcatttgagatgcctgaatgtaaaattcgtactgctctgggcagttatatggaacataaattcttggatttttagcgcctggcgtatctatttttgagtctctagcaatttctgcaatattataaagatcaactcttctcgttaaactcgtccaaaattgagtcgttatcaatcttgataatctatcaacagggttttcatttatacgcgcctcatccaaaaatatttggtgtcgtccgaaactttttgcaatggttagttcctgcaacaagttagaaagcatatatgttcccctaacatttacatgtttgaaaccgttggaattggccgtcccgactttaataactttgggcccagtgtcttctatggtaatttggtgattcttgtctgtgtcctcactagcgagcagctcatctaaagcgagatccacattatcaatataaaatctacggttaccttggctgctgaggaagctgtcgtcttcagaacccctccttttcagggtataatccttcattccgtttttgaagtcagaaactttattgaaaacactcatagttctggttctatttagtctatgaatttttgactgttttcttggatctgttattggtccataatagacctctgcgttggaaaacgggtcaaaatactcatgcatagaggacaaccgccggtgatgtcttctaccaccttgttgcccctcttctttcaacggccgctgctctgaaccacttgaaagtggctttatgttatcttcaccatcattaccttcggatggaggatttatttccgttacttttggtaaaaaatctaccattatttgagtatatgcaggtctccttatataccaaatgtctgatccgaacctgcgtcaaatatatttgcaaagggaaaatataaataaataaataaaattgagaaataaaggatattagttttaatggaaaacagttcctacaagcgctataacatatgaaatatacattagtcgaatattaactttgggaggtaattacaattcctatccgctttatataatttagtggaactggcacgccgctcggaaaaattggacttcaaattaccccgcgcggagatttgcattataaactctataaagatgcgtgaatttctactcatttattactaattatttgaatgttcttttgcgaactcatttatcttgctcattactctataaatatctatgccatgtggtaggaaaaaaatgcagacctttcttaattcaactttttttctttcaaatcgatggggtccccattggtttcctcgtcataatcaccttcctctaatctgtactctttgtttaaaaaggatttgtgaaacgaaaattttaataaaatccatgccatccgtataggtccaaactctggccataaacaatccagcaattcgatgcgtacgcccttactcgatgcctgccatatcaaaaagtcacttaatctggaaacgccacttgtcctaatcaataaatctaaagggggtacccccgccgtgtagagatgcgattctaacgtgctttcgtctatagcggcgcccttcttatgttgaacaattgtttctttcatggcatgcaagatttcttccctgcctgtatatggaaagcagatatttaacgtggcccttttgttgttctttgtagtttccacagcaacccgaacatcttctaatagagacttatccaacaaagagagatcgccgataattttaatgcgtaccccatacttacaggccagctctccacgttctgtgatttgtcgtatcctttcgcgcgctaaagtcatcagtgattcaacttcccgtgagctcctcttgaaattttcaattgaaaaggcaaacacggtagccgtatcgactcctgcttcataacacagttctaagattctactcatactaacaaatcctgcctcgtggccctcctttacgtccatctctttctttctagcgaatctcctgttcccatccatgatgaacccaacatgtctaggtacacagttagatgcacgcaatgtgcgcgaaaagatgttttttgtccactttaacacaaatgaatgaccaggtataccactatccgtttccataccgtcttttacctgtgtttaccctatttttactgcttaagttctattgaaacctgtcattattacgaaaatttttttttttttcattctaagcattttgttggcatcttcggaaaaagcccgagcgagggtaacagggttaggggattagaagattaaagtaagacacattataatctatagagattttctacaacacaagaagtgtgccattcagtccgaattgagtacagtgggacgatgtttcaaaggtctggcgctgctcatcacatcaaattgatttcatctcgaagatgccgctttaaatcctcctttgcagttgctttaaacgctgccagtaagttggtaactcccaagattctttggaataatcccatatcattagtctcgaaggagatgaacacattggccaaaaatatagttgccctcatcgggtctggccatccggtgctaaacaaggttactagttactattttgaaacagaaggcaaaaaagtacgtcccttgttagtgttgttgttgtcaagagcactttctgaaattcccatgacagaaagaaatcacttgaaaattgacaagtcggatgttcctgaggacccaatttactctaaacctagtcaaaatcaactatttcaacgtcctgcaagtagcatatccccactacatattcttcacggtattaaaccactaaatcccttgacaaaaggtcctgagcctttgccagaagaaacttttgacaaacaaagagggattttacccaaacagagaagattagcagagattgtagagatgatacacactgcgtctttacttcatgatgacgttattgatcattctgatacaagaagaggaaggccaagcggaaatgctgcctttaccaacaagatggccgttttggcgggtgattttctcttagggagagcaacagtgtcaatttcaagattacacaaccccgaagtcgtagaactaatgtctaatagtattgcgaatcttgtcgaaggtgagttcatgcaactgaaaaatacttccattgacgcggatatcgataccatcgaaaatggccataagctacttccggttccttctaaaaagcttgaagttaaagagcacgactttcgtgttccaagccgccaacaggggctgcaattatctcatgatcagattatagaaactgcatttgaatactacatacacaagacctatctgaagactgctgctttgatatcaaaatcttgcagatgtgctgctatattatctggggcatcacctgccgttatcgacgaatgctatgatttcggtagaaatctaggtatatgtttccaactcgtagatgatatgcttgattttactgtgtctggaaaagatttagggaagccatccggcgcggatctaaaattaggtattgctactgctccagtcttgtttgcatggaaagaagacccatctttaggtccactaatttcacgcaatttttcagagaggggtgatgttgaaaaaactattgattctgtgagactccataatggtatagcgaagacgaaaatactagcggaggaatatagggacaaggcattacaaaatctacgggattctcttcctgaatctgatgctcgttctgccctagagtttttaactaatagtatactaacaagaagaaagtaaaccttgaaatttcaaataaagggtgaagaataaagagaaaatgaagaaggtcatagtgtcgcattattctatattctatatgtaaatagtttttatatgtttttagtaaaagaagaaatatacaagcattaaggatcaggctggtggtaaaaaagctgcaaataggatagtctgtaaaggtatccagaatgccaaccagtatatgtaaaacttgactatcttatcgtcacctttcggattttccattttttttggatcagaagttttaaccaatctatcagccaaataccaaaggtgcaagggtaaaaaggaggctatacgattcagaatttggacatgggcaaaaaagcatactatgacgaccagtgctctggtgatccatacgagagccttcaagttataggagggataaattttgctgaaatatatggaggaatagattaaaataataatatttgggacagcaaacaaaaagtttgggatgttgtttggggtccagtatttcaataacccaactccccaataatgactctgaatgtaggaatataaagaagttttcgtgataaaaatgcttgaaaacaattgagatttacaccattcacccctttgaggacaaaatgtcttatatggtaggtaatattgttgatatagtagagcagaaaacattaatgatcctgataatagtgggaaacatattgcttttacaaacttcctgttctttgttagttcaataaggtcaaaaataaagtaaatccctaacaaaacacagtttgaacgattcaaggatgctaaggtaaagcaagccatgctgataaaggagtaaggaaaccaatatctccacgaaatatcgaattgacccaatacgggcacggaaatggtgcattcacgactccaaataccaacaaatgcaaaaaaaaaagataatggttcagaatatatgcttgttaaaaatccagcggcactcgttaagaaaaacaacagagatgtttttttagcgatagttctagcaaactgtgattgccttatattttggctgaaaattttttttgttagaaaatataaaacaatacctgacaagtaaaataaaacattttctattgcaactccaacccttaaggcatggtagatgctatcgttattacttttaataaacagcctaacgaaaaaagtccacaactgagaaaacgcgtattcatgctcaaattgaggttttccgtttttggaagttatgttcttgataaaaaaaacactgtcccatgatagtagcttattccaaaaatacttgttccaataactgttgatttcagagggagaagaacataattcgtttaataaaagtgatgttgatgtatcaaactgcctaattggagtcaaaaaaaccagtaaatactgtattgaacggaataatacaaaataaagtgtcaaccccacaatcatattttaatttagtcttattccgcctcctctctcgaagcctctcttttatgtcttttttcgatgatgaggcttactttttttttcaactaagccttgaaaaaaaaagtttgatttaaaagggattttctattttaagtatttaaatgaccgacaggaagctcatgcagaaaaggcacctgtaatagcttattgatcattccaataaataggaaagtataactcgaattaagaataaggaatgggacttatttcatacgaaaatgaggcgataaacgaggtgaaaaaggcagataaccatcacgttagcaaatttgtgactagttactatgggccatcatcgtcgtcatggcagtcaggaatatggattttgtttgtgctgtttgttgccgcagtaatccttataatactgttcacttttgtagcgaacagaaggagacgaaggatggggcgtgctcccattagaggtacggcatggttgacaccgccttcatacagacagtctcagcaacaatatactgggaccgttcagcaacggacagatgattatgttcctgagtatacagaaacagcgaacgaacatgatcttggatactatgaccagcggggcgagtttcaccccaacgataaggctgcatacgtggcccccccgccattggtacaagaatgttcatcagaatctgttaattctttagaaagacctcccgctgctgtagttcaccaagctaactctttagatacggattacggtttaacaaggcctagcaatgggcgcgttccagctgtaagtgatacggtggagcaattggaaaggcttccgggcgggactacaacgcaggaaattaacccaccggagagggcaaaggtaaatgcaaggtcatgaactgaatctttttttccggctgtcctcttacagttgagttacaatattttgccagaaatatttacatttttttacccaatctctataataattattttaattcctaatccgcttcaggcccgcggtcgttgaagtgctatagtttatattcagtacattgtctttaatctctcagtattattttatcaatagtaaatacttcaagtccatcgcacggcgtggtggtgataaagggaaaatgcgcgcgggattagcaaaggcggccaatggattaagggtgacaagatagcaccacatcacatcacatcaccatcagtaatggagaggaaatagggtataaatactcgtcagagatcaatagatattatttcgcaacgtcctttattgttctgttcttatttgatcaattaagctagaaaaccagctacattaaaagcaaattttacaaactactatttcaacatgactttgagtaagtattctaaaccaactctaaacgaccctaatttattcagagaatctggttatattgacggaaaatgggttaagggcactgacgaagtttttgaggtggtagaccctgcttccggcgaaatcatagcaagagttcccgaacaaccagtctccgtggttgaggaagcgattgatgttgcctatgaaactttcaagacgtacaagaatacaacaccaagagagagggcaaagtggctcagaaacatgtataacttaatgcttgaaaatttggatgatctcgcaaccatcattactttagaaaatggtaaagctctaggggaagctaaaggagaaatcaaatacgcggcttcgtattttgagtggtacgccgaggaagcaccccgcttatatggtgctactattcaacccttgaaccctcacaacagagtattcacaattaggcaacctgttggtgtatgcggtataatttgtccatggaattttccgagcgccatgatcacgagaaaggccgccgctgctttagctgtgggctgcacagtagtcatcaagccagactctcaaacgccgctatctgctttagcaatggcatatttggctgaaaaggcaggctttcccaagggttcgtttaatgttattctttcacatgccaacacaccaaagcttggtaaaacattatgtgaatcaccaaaagtcaagaaagttacttttactggttctacaaacgtcggtaaaatcttgatgaaacaatcttcttctactttgaagaaactgtcttttgagctgggtggtaacgcccctttcatagtctttgaggatgccgatttggatcaagccttggaacaagccatggcttgtaaatttaggggtttgggtcaaacatgtgtgtgcgcaaatagactttacgttcactcatccataattgataaatttgcgaaattactcgcggagagggtcaaaaaattcgtaattggccatggtttggacccaaaaactacacatggttgtgtcattaactccagcgctattgaaaaagttgaaagacataaacaggatgccattgataagggagcaaaagttgtgcttgaaggtggacgtttaactgagttaggtcctaacttttatgctccagtaattttgtcacacgttccctcaacagctattgtttccaaggaggagacttttggtccattatgtccaatcttttcttttgatactatggaagaagttgtcggatatgctaatgatactgagtttggtttagcagcatatgtcttttctaaaaatgtcaacacttaatacactgtgtctgaagctttggaaactggtatggtttcatgtaatacaggtgttttttcggattgttctataccatttggtggtgttaaagagtcaggatttggaagagaaggttcgctatatggtattgaagattacactgttttgaagaccatcacaattgggaatttgccaaacagcatttaaagcaatagtaatcgtggacgatacttagaattgaatatgattctttgtaatgattgtatatatctattgcatgaataaatactctactcctcgtatatagaaagttaagtaaatttttgaaagaaaagagttcatatatttacggagttttgaagtttttcacaagcggaataagtgataccattcataaaatatcatatctatctatctatctatttttgtgagatatatggtacgaaaataaatgcctttccttttaagcctttctgtaagcttttatgtatacaacgtttctttatctttatttcggaccttgtttcatgtacttttccttataaatccaatctgaacctaatagatttgcaccttttttatcggctatcctaaaccatgcagcagctctggcgagatcccttttctttacgtttgaagttttggaccaaattgtcccgcttaagcacattgagtctacatggcctaatagagcagctttttccaaaaatttcaaaccttttcgctcgtcgggatgatccatcccaagaccctttaaatatgccataccacattcgtacaaggcaggtgctgttggttcaggcgctatatcagggatatcgtccattgaagcaaaatttaacggatttatatctaaatcaagaacctcagcagcaaaggatttgatatcagtggcagccattaaatatcctaatgataatttcaagttcttgtccactccgcagccatgtcgcagggctagtccatataacagaaacgcagttttgtttccgcacgcgcaggcttttttcagtcgttgtgcagattcttcaagtttgccttgatgacgcatagtaattgcctgtccgatgtgtgaagattcatcattatcataaggttctgggtgaaatttaagcttcccgcacttgcttgttgcgttcgatccttcttttttatgactgaaggaatccatgcattgcgtcgaattattgggcaacataccatctaaagaaagtgttcttcttctaactttcgggtggtagggcttatttgattgttctgttagtgcacttagttcacctatttttgaatctttttccgttgtatggaaatccgagaaagttctcaaatgagtcctatttggacgtgctttactgttcttttttttatccgtggatgactgaggtgttgatgctgttttaaaatggaaaactgggtttggaggaaaaatatacctagctaaatgtggactggaattattaatggtacttgaagtagatggaagttgaatattctccccagagaagtccaatgaattggtggcagaccggatagggcttgatccttcagactcaaggtctttcttattttttgctcttgtcctaggagatttaaaaagtttttttagcgaatttagtgacgttttttttttatgagctttatatggtggcgttggaggtaatgaaatatcatttgtcatggtatttgttttcgttatcgtcgaggtagaggaattagaccgtttaggagatggtttgatggttgttgtatcactcttagttaacttgagtttggagaatgaggatgattcactttcaaaagaagactgagttttcggctttgatagttgtccaacttcagaaaaggaggtgttggtgcttgttgaacttccgttccgataaagacaattactcttttgcgtggttgtgaactcattggggcaactctgcttctcggatattctgtcagtttttgtagatgtattaatattattactagtagttctgttattcttactattagcattattgtcaacgctagtattattgtctgatatcagcgtaggataaagatggtgcagtctagtattttcaatcctatatttctcgaagttgaaaggattaggcctatttgtgcttctattgccattttcaaggtttgggtacttataatctttctcatttctattcatttggggtttcatgccactaaaagtctcagagtcataatcttcttcgacgatataagagtatctcgacttcacgggcaaatgcctttccactttaccggaagagtatttgcctctcaaagtggaatccttttcttttaaattgtctatgataagagaacgatctctagcttgtatatatgttggagagggattagttctataccttaatgaagggaattccgacgcaggcatacataatgttggaccacttgtttgtgacagttgcgaatttctcgacgcgttttcttcttctaataaagcttcttgcagaatcagttcatcttccaagctgaggtctaatttgtcaagaagtctttccgtggtttgaatagattcgaatgaaatgctacttttatttgaatgagcatagctaaattgtgaatccattgatgactcgaagctattattgggtggtgggctttgtgaaacctctgaagagttagcttttctttcttgatcgtcgcttcctattcgatcagcccaagaagtgttttttaaattttgattcattacttttcgtgtgacgtaaaagtccgtttgtttttctagattttctgttttttctcgaggctcctacaagttccacctatatttagcattgaggaacagaatgtgctatcgcaaagagcaatggcaacagaaaaaaagagttgctaaagaagaactatttttgaatgtccgtggtaatacaatggaagactactagaacacgatggcagataaggtgatttgataatcaaattcaacgacggttgcaccgttgttctttctgccgctcttcgtccggagccttctgtgataattgttttaacgcgcagaaacacacgcaggctgcgtaaaggaatggtggggctcgaagaagtgacagtgggtgtccacggaatgttctgagcgcagggatccggtgttgccatcgcacacgatatgagacgcgttcattttttccagcagtcacctaaaagttcaagaaacgctatgttgtaatgcagctgtattgtacactggctggtattgccgttctgatctatgacttacttgttagaggtaatagctgtcttagatcggcttgcttcttctgacttccttcttttttttttttttttcgaagtgaggcatgctgcagttttgtgcagcttctcttgcatcacttcctgtattatttacgttgtttacattatcaggtattttgtattattttttgcgcaacagcaagcaaacgcaatagcgataaatgccataatataatcaaaatttagcaaggatacatagcagcaaacccgaacctttaggcctctcatagatgaagaaaatttgtacaattcttttggttctttggctcttcaaatatgaatttattaagaggaaatcctgaagcatcagaacatcgcaaactttttattcgcaagaggatttatcctctgattagttatatatgaatatgtgttccttctgcatgattttgatatcaatagtatgcattttttttcgattcgtcgtagaaacatagctactctcatgaccaaatgactctttttggctttgacagtggaacagccaagtttttatgtagaaatatattatctgttaactggaaatgatgtcttaggcccataaaatgtgctagaacgtatggctaatccttttgctctgtattcaattgagtattttgcttaatttctatttgataattgaacttcttacgtgtataaatggttgcatatttctttagtaagtactattttcaaatatgagtgaaggatattgtggctcaagtaattcctctttcttttttcatccgtatggtaagcaaagggtcacaaagtaaccgatagtgtgtagaccttagatcttccttcaaagatttcaagtctgcgataaataaacatgagaatacttgcaacaacaacttttataaacaatgaagttcattatgaacagtatttatttcactgctaaactttacgtaaacttatgtggaacatctttgtcgacagatggacgataagtaaaattgtgttattataattcaaattttcatggtaagaacatcggctttctactcctctgtgtacgaagatcttgtacgtaatgatggcccatacttataaagtataaacgggataatagctagacctaaagttaggaaccccactaaggacgaaccccatgccacaggatagttcttagtagctaaattgtcatacattgctctaccaaacaacggaaaagcacaggcaaacgaagcccgacaaaaaccattgcctgcaaaaacggatgcaacatactttgggtagcatgtagccaaatatgcaaaagttgcttggaaaatgttaaagacagctaaaacaaaaaaaacttccgagataactggcaaaatccaatgcactcgagcagtccaaccaaataagaacaaagacagaggcaggcaccagcagacacacattgccacgattaaaaaagcttccggggtgaatgtgccgtttctaaaacgtggtacaataatcctcatgtttaaaataccgaataagccataagcaagtacgcaccctacgcaaaaccccatataggccaagccaacttcaactaagctgaagtggtatatacctacaaatacaatagggaatgcttcaaagaataagtagaaacaaccataagcaacagcgatatagagatcaaaagccaaaattgcaggctctttgataatcattttgagaggcctatacaaagtattgatcaaaaaagttcttgcatcaacttctctatcgagtttatcctgttcagtatagtacctgtcatcaccagtttcttttctcaatttcaaagcacggcggtacaaaatattatggtgttgtgtttcagggaagaaaaatgccaacaagataaaagtggcagcacttaaccacattaataaccaaaatatgaatcgccaatttttagcatcgaccatagcagcgcctagtaagggagccaagactggcgcagcaacagcaccggctgaccacatacctaaaacgagaggaaccatttctggtgaaatgatatcagccactgtaccgccaccagtggccaacgatgggctgcacagtatgccactgatgaaacgcatgacgattaaaccgccgatgttatgcacagtagcacaaccaacttgaaagatcatgaaaaaaaataaagtcaccatgtacagatttagacggccatagcgtgcagtttctgatagcggtgaaaaaatgatgggacctagaccataaccaagaacatataaagaaagatttaatgttgccactacatgaccaacgtggaactcttcttgaatatattcctggccaggtgtgtaaatggaggatcccatgtacgtgacgcaagtaagtaacattatttggaatactaccaatgattttttcagtaggggccagttttgtgggttctcaggatcactggggccgttccaatccaccctgaaaggatcatttttttcgatctgtgaaccactagagtctgaatcggtagaggattcagagcacgatctattaggaccgcattctatatcatagtcgggtttacattcttttttatcggtattctcgggttttcttgtttcatcttcacgggcactctgtaaagtttctaagttggacactatacccaaatattctaaaaggtcaacaacgatagtgtgtctgtacgttgaagtgtataccatagtggagattgtcgttcaacggatactcttttataatagcttcaccataatgacaaagacggcataaggatgtagatattttagcctcgtaaagagctgtttaaatgcaattctcgtcttctttcctgttccccttttacctgactaattatcccgcccattagtcagatgattgataccaattttactcaaatgtgtactatcatgtcccttttcgcactgttattgctccttacctaagcaaatatccttttttttttctttgcatttgtcttctttcatttgaaatcttcataatcttccggaaaaactagtgatgcgcaatattgtagagaaaagcgcagggcattcctatacttagtaatcaccatcataacgtattttaaaatgaagaagcgaacctcatagaattttctatacagaagagacctttccgcgcatatacgcggtagcgtgtgtcagcatcagaggtttagcataatatattgcagaaaatgtgctagtaatatgtctctctgttgtcaatgggcttacaattgccggccatcagtatatggagtatcaatgttccttttgatcgccaacaaatactaccttttatcctgctcttcctgctctcagatattaatgccgaattgtttcatcttgtctgtgtagaagaccacacacgaaaatcctgtgatttttcattttacttatcattaatcgaatgtatatctatttaatctgcttttcttgtctaataaatatatatgtaaagtacgctttttgttgaaattttttaaacctttgtttatttttttttcttcattccgtaactcttctaccttctttatttactttctaaaatccaaatacaaaacataaaaataaataaacacagagtaaattcccaaattattccatcattaaaaaatacgaggcgcgtgtaagttacagacaagcgatccctattccatgcaagttcggtaagtagcagaaataatcaaactgtttaaacccaattaaaattaaattaaataccctttatatgtttataattgtacatatttctcctaaacccgctataatacactcatatttgtagaagaaaaaccgggcagttgaatacgaatcccaaatatttgcttgttgttaccgttttcttagaattagctaaattaaccaccgaaaccgtataaggttctaccttgtctcttcaaagcataaacaacatccaaagaagtaacagtctttctcttggcgtgttcggtgtaggtaacagagtctctgatgacggattccaagaaggatttcaagacagctctgacttcttcgtagatcaaaccagaaatacgcttgacaccacctcttctagctaatcttctgatagctggcttagtaataccttggatgttatctcttagaatctttctgtgacgcttggcaccacctttacctagacctttaccacctttacctctaccggacatattttactatattatatttgttgcttgtttttgtttgttgctttagtactatagagtacaataatgcgacggaaaccatcatatagaaaaaatatctcggtatttataggaaaaagaattagaccttttccacaaccaatttatccatcaaattggtctttacccaatgaatggggaagggggggtggcaatttaccaccgtattcgcgggcatttgctaaagtaaacaacttcggtttttaccactaaccattatggggagaagcgctcggaacagttttactatgtgaagatgcgaagttttcagaacgcggtttccaaattcggcggggagatacaaaaaagatttttgctctcgttctcacattttcgcattgtcccatacattatcgttctcacaatttctcacatttccttgctctgcacctttgcgatcctggccgtaatatctctccttgacttttagcgtggaagataacgaaatgcccgggcgatttttctttttggtaccctccacggctccttgttgaaatacatatataaaagactgtgtattcttcgggatacatctctttcctcaaccttttatattctttctttctagttaataagaaaaacatctaacataaatatataaacgcaaacaatggccagaacaaagcaaacagcaagaaagtccactggtggtaaggccccaagaaagcaattagcttctaaggctgccagaaaatccgccccatctaccggtggtgttaagaagcctcacagatataagccaggtactgttgctttgagagaaatcagaagattccaaaaatctactgaactgttgatcagaaagttgcctttccaaagattggtcagagaaatcgctcaagatttcaagaccgacttgagatttcaatcttctgccatcggtgccttgcaagaatctgtcgaagcctacttagtctctttatttgaagataccaacttggctgccattcacgccaagcgtgtcactatccaaaagaaggatatcaagttggctagaagattaagaggtgaaagatcatagtttgttgattgtcatcagttttagtaaaaaacgaacaaaaacacaataaaatataaatcaatatatttaggtttactgggttctttaacagttgtataatagttattttttattacaaaaatataggttttaataaaaaaaaatagggttctatttgttttacatttattgatttgtttttcctggcgataccctcgaaaaaagccaggccttgtaggaggcaagatttatggctttccatgtggttaaagaaaaattgcagcaggaagatattcattcatgagtcagttatataatcgatatatagctacatattaaacaacttgaagccgcatacgtggtaggtgtctcattttcaattcaaaatattttaaacagaaccggagatgaagaaccacttgtcaatagacttgtcaattggagcatctgcctttggagaagctggtgggatggcatcagaggcagccttggagtaggttggggtgtcaggcaaagtaacattggtcaaatcaatacccttgctgtcagaagacttaccagcaattaattgtttccaggagtcatgtgtttccttgatgatatccaaagcgtacttcttgttcttagcttcaccggagaaggcaaattggttttctggcttaccatctgggattttgtaaattctgaaccattcgttagtagccctcaacagacctgggaagtatttctcaacatcctcaatgtcgttcaattttggggctaatggatcgttaatatcaatggcaataactttccaatcggtctcaccttcatccaataaagccatgatacctagagccttaacttgcttgacttgaccagtgtaagcaatagtttcaccaatttccaacacatcaattggatcgttgtcaccaactgccttagtttctgggtggcttacgtttgggtcttcccaagtttgtgggaaagcaccatagttgtgaatgtaaccatggtgagggaaacagtttctaacaaatctcaacttgcccttcttggtgtcttggatgattgggttcaaagtttcttccttggtgatttctaacttggcgttggtccaacgtggaatttcaacaaccatgttgaaaatgttgttttccttgtcagcgtacaagggaatgtcgtggaaggcagaaactggcttaccatccttttcgatataaactttgtattccaaggtgttcttggcaccaatttgtctggtagtgtaggtcattagtaaattgcgcggcgggatatcctgttctatagacctaagggacaacaaatcaaaatagatgattaagaaagtaagtattcaaaaacaagttgtaaatgaactaaccttcctaacttcgacgcgaccttaaaacgtcgaaaaaaaacgagaaaaagtcatcatgagactatcgtatctaatgactgtggcttctcccaacaaccttagcgtctgcgatgacgatattttgaagaacagtcaaatccgtttgaatagtgcgccacacagggataataatagcacattggcatctccttctgtgaatgaaacacttctacctgggcttcaaagtcccgcaaccttttagttacataaaattcggcggctaaatcatgatattatattgatgggtaatgtagcgttcagtaaaacggttcctatgtattactatcacgtgggtggggaagaccacattcttagagaagagtaatcattttagcagattatttttacctttttcaactcatgaactcatgttcaaaggtacaatatattaccctttcttcaaagtatccgaatgatttgaaccgcactctgagggagccatcaaattctattgagcgacttcgaatcgaacaatccaattaaatcagcctttagcgccatatttctccttgtatccattgtttacttctcccttgtatcttgtatatgagaattatgggaataagataattgttgggattccattgttttcaaaggctgtaatattaggtacacagattatactagaagttcttttcgaggatataggaatccacaaaaggaaatcgatagttatacataataatattattgtatcttacttccttttatatgttgtcactcattattgtgtcgtgcattccattagattggatgactgtttctcaatctttatgccatcctcttacaccgcatgtgatataatagtaacatgagtgctgcgaaatagatgatattaaaatttcattccaacaaagttccatatatatccatatatatatatatatttcacgaggataatgagttaaaatactatgtaaaggtattgtggttcatttttcttttatcaatttttatccaagtttttctgatctataacatgtccaatacactttttcgaactataaccgccaacaaatttatcttatagacgagaaacacttttatgatatcgatgttctacacctactgccgataacaccgtgttttcactattatagcatataccatttttgtaaccaatgtgttgttgtaattctccgcaaggcatatcccagatattcttatatggcccatttccacttcgttgaagcctcacatcaaaagagcaatcttgagataatttcaaaaccacacacatcgctgcagtttcataatatctgtcatcactgatgcaataattaagtgacgaaattatatcattattaacagctgtattattattataatcaagacaagctgaatttgatgcaaatatatattcccattcagtgccgtttctttcgaatttatagaaatcacttctttgtaggtaattgttctggcttactttgagcttattcatgttaaagtaattgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgcaatattagtatgtagaaatatagattccattttgaggattcctatatcctcgaggagaacttctagtatattctgtatacctaatattatagcctttatcaacaatggaatcccaacaattatctaattacccacatatatctcatggtagcgcctgtgcttcggttacttctaaggaagtccacacaaatcaagatccgttagacgtttcagcttccaaaattcaagaatatgataaggcttccactaaggctaactctcaacagacaacaacacctgcttcatcagctgttccagagaacccccatcatgcctctcctcaacctgcttcagtaccacctccacagaatgggccgtacccacagcagtgcatgatgacccaaaaccaagccaatccatctggttggtcattttacggacacccatctatgattccgtatacaccttatcaaatgtcgcctatgtactttccacctgggccacaatcacagtttccgcagtatccatcatcagttggaacgcctctgagcactccatcacctgagtcaggtaatacatttactgattcatcctcagcggactctgatatgacatccactaaaaaatatgtcagaccaccaccaatgttaacctcacctaatgactttccaaattgggttaaaacatacatcaaatttttacaaaactcgaatctcggtggtattattccgacagtaaacggaaaacccgtacgtccgatcactgatgatgaactcaccttcttgtataacgcttttcaaatatttgctccctctcaattcctacctacctgggtcaaagacatcctatccgttgattatacggatatcatgaaaattctttccaaaagtattgaaaaaatgcaatctgatacccaagaggcaaacgacattgtgaccctggcaaatttgcaatataatggcagtacacctgcagatgcatttgaaacaaaagtcacaaacattatcgacagactgaacaataatggcattcatatcaataacaaggtcgcatgtcaattaattatgagaggtctatctggcgaatataaatttttacgctacacacgtcatcgacatctaaatatgacagtcgctgaactgttcttagatatccatgctatttatgaagaacaacagggatcgagaaacagcaaacctaattacaggagaaatccgagtgatgagaagaatgattctcgcagctatacgaatacaaccaaacccaaagttatagctcggaatcctcaaaaaacaaataattcgaaatcgaaaacagccagggctcacaatgtatccacatctaataactctcccagcacggacaacgattccatcagtaaatcaactactgaaccgattcaattgaacaataagcacgaccttcatcttaggccagaaacttactgaatctacagtaaatcatactaatcattctgatgatgaactccctggacacctccttctcgattcaggagcatcacgaacccttataagatctgctcatcacatacactcagcatcatctaatcctgacataaacgtagttgatgctcaaaaaagaaatataccaattaacgctattggtgacctacaatttcacttccaggacaacaccaaaacatcattaaaggtattgcacactcctaacatagcctatgacttactcagtttgaatgaattggctgcagtagatatcacagcatgctttaccaaaaacgtcttagaacgatctgacggcactgtacttgcacctatcgtaaaatatggagacttttactgggtatctaaaaagtacttgcttccatcaaatatctccgtacccaccatcaataatgtccatacaagtgaaagtacacgcaaatatccttatcctttcattcatcgaatgcttgcgcatgccaatgcacagacaattcgatactcacttaaaaataacaccatcacgtattttaacgaatcagatgtcgactggtctagtgctattgactatcaatgtcctgattgtttaatcggcaaaagcaccaaacacagacatatcaaaggttcacgactaaaataccaaaattcatacgaaccctttcaatacctacatactgacatatttggtccagttcacaacctaccaaaaagtgcaccatcctatttcatctcatttactgatgagacaacaaaattccgttgggtttatccattacacgaccgtcgcgaggactctatcctcgatgtttttactacgatactagcttttattaaaaaccagtttcaggccagtgtcttggttatacaaatggaccgtggttctgagtatactaacagaactctccataaattccttgaaaaaaatggtataactccatgctatacaaccacagcggattcccgagcacatggagtcgctgaacggctgaaccgtaccttattagatgactgccgtactcaactgcaatgtagtggtttaccgaaccatttatggttctctgcaatcgaattttctactattgtgagaaattcactagcttcacctaaaagcaaaaaatctgcaagacaacatgctggcttggcaggacttgatatcagtactttgttacctttcggtcaacctgttatcgtcaatgatcacaaccctaactccaaaatacatcctcgtggcatcccaggctacgctctacatccgtctcgaaactcttatggatatatcatctatcttccatccttaaagaagacagtagatacaactaactatgttattcttcagggcaaggactccagattagatcaattcaattacgacgcactcactttcgatgaagacttaaaccgtttaactgcttcatatcaatcgttcattgcgtcaaatgagatccaacaatccaatgatcttaacatagaatcagaccatgactttcaatctgatattgaactatatcctgagcaaccgagaaatgtcctttcaaaagctgtgagtccaaccgattccacacccccgtcaactcatactgaagattcgaaacgtgtttctaaaaccaatattcgcgcacccagagaagttgaccccaacatatctgaatctaatattcttccatctaagaagagatctagcaccccccaaatttccgatatcgagagtaccgattcgggtggtatgcatagattagatgttcctttacttgctcccatgtcccaatctaacacacatgagtcgtcgtacgccagtaaatctaaagatttcagacactcagactcgtacagtgacaatgagactaatcatacaaacgtaccaatatccagtacgggtggtaccaataataaaactgttccgcagacaagcgaacaggagactgagaaaaggattatacaccgcttcacctccgatcggatacttccgtcatcagaaagtaattcactacaccatgtcgttcctatcaaaacgtcagatacttgttttaaggaaaatacagaggaatctattatcgctgatcttccactccccgatctgcctccagaacctcctaccgaattatcagactcttttaaagaacttccaccgatcaattctcgtcaaactaattccagtttgggtggtattggtgactctaatgcctatactactatcaacagtaagaaaagatcattagaagataatgaaactgaaattaaggtatcacgagacacatggaatactaagaatatgcgtagtttagaacctccgagatcgaagaaacgaattcacctgattgcagctgtaaaagcagtaaaatcaatcaaaccaatacgaacaaccttacgatacgatgaggcaatcacctataataaagatattaaagaaaaagaaaaatatatcgaggcataccacaaagaagtcaatcaactgttgaagatgaaaacttgggacactgacaaatattatgacagaaaagaaatagaccctaaaagagtaataaattcaatgtttatcttcaacaggaaacgtgacggtactcataaagctagatttgttgcaagaggtgatattcagcatcctgacacttacgactcaggcatgcaatccaataccgtacatcactatgcattaatgacatccctgtcacttgcattagacaataactactatattacacaattagacatatcttcggcatatttgtatgcagacatcaaagaagaattatacataagacctccaccacatttaggaatgaatgataagttgatacgtttgaagaaatcactttatggattgaaacaaagtggagcgaactggtacgaaactatcaaatcatacctgataaaacagtgtggtatggaagaagttcgtggatggtcatgcgtatttaagaatagtcaagtaacaatttgcttattcgttgatgatatgatattgttcagcaaggacttaaattcgaataaaagaattatagcaaaactcaagatgcaatacgataccaagattataaatctaggtgaaagcgatgatgaaattcaacacgacatccttggcttagaaatcaaatatcaaagaggtaaatacatgaaattaggtatggaaaactcattaactgagaaaatacccaaattaaacgtacctttgaatccaaacggaagaaaacttggtgccccaggccaaccaggtctctatataaaccagcaagaactagagctagaagaagatgattacaaaatgaaggtacatgaaatgcaaaagctgataggtctagcatcatatgttggatataaatttagatttgacctattatactacatcaacacacttgcacaacatatactatttccgtccaagcaagtgttagatatgacatatgaattgatacagttcatatggaatacgagagataagcaattaatatggcacaaaagcaaacctgttaagccaacaaataaattagttgttataagcgatgcctcgtatggtaaccaaccgtattataaatcacaaattggcaacatatatttacttaatggaaaagtaattggaggaaagtccaccaaggcttcattaacatgtacttcaactacggaagcagaaatacacgcaataagtgaatctgtcccattattaaataatctaagttacctgatacaagaactcgacaagaaaccaattaccaaaggattactaaccgacagtaaatctacaatcagtataattatatccaataatgaagagaaatttagaaacagattttttggtactaaagcaatgagactgagagatgaagtatcaggaaatcatctgcacgtatgctatatcgaaaccaaaaagaatattgcagacgtaatgaccaaacctcttccgataaaaacattcaaactattaacaaacaaatggattcattagatctattacattatgggtggtatgttggaataaaaatccactatcgtctatcaactaatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccatttggaggattcctatatcctcgaggagaacttctagtatattctgtatacctaatattatagcctttatcaacaatggaatcccaacaattatctaattacccacatatatctcagtaattcacagttaacaacagttgataaaaaatattctgtatacacgtccccactctgtgataaagcttcctgtttgcttgtaaattaagtgaattttcaagggcattatcaaaggccttagtaataatggtaataatatatggatacgaagaatttttcgtataatcgcatgcattattacttaacatattttcagttgaataattcattgaaagagcgtctgactcacaaaatggcgcagattttgccaaagtattattaatttgtacactattatgagagagagttaccccttcaatacccttttgcgtactattttcaagacatgcatagctacccaacagaaatgcacctaggatacatatcctgaataagggatatatcattatgaggttaagtggcctaaaacactcaattaatacggatcccttgtactattaagtcttttctatctctgaaaattaacttaagaagcgaggctatctagattagtgttgatgtatatgtgtatgctgtcctggtgtagctgtggtttttatagattatctcagatttgtgatactctgtaagtggcggcctcattttgtctctccttgaatacgaaaatttgtgggctaaagatttattctcatcaacaaatcaagtaacaatcattcgtgttggaataaaaatcaaataccgtctatcatctaacaccgtatatgataatatattgatagtataactattggttgatagacgatagttgatttttataccaacactaggaaaccacaatccaagatgagataaatatagaggaaaatacaagtttgagtttagatctgaagttaccttaacatttgtataagcaaattcgctacgcgactctcacatcaaaaactgcttctatggccaagttggtaaggcgccacactagtaatgtggagatcatcggttcaaatccgattggaagcatttttttgaatactgaaaaattaagctgatcaccaaactcatgtaatatatatgcttgactatacaaattacaggcttcttctcatatttttctgctctacgttaacctactttaaacagtccaaaaggcttatgttgtccacatgaaatgcctaaaacagatggccaatatttaatttttttccttactacatttaaatctgtatactacctaaatatcctctttcgctactgtgggagaagaagaagaataactctcagtttataatctgatctaggcactctcagattgcgaattagcttttacagtaaacgccccatcgctccattttttgaaagagtctagaagttcatcatttttatgtaactctgctatctcagtataaccacctctggaagtaccaccgatgataacgtttgggactgttctcctaccagtgactttttcaatctggtcttgtagttcttttgtgtgttcgtgcctatccaattctacaacgtagtaagatggagaaaacgtgtacgaattagtcaacaaagctttcagttttttgctatatgggcagccagtcttgctaaatacaatcatgggtgactgttccattattttgttgtattctgcagcggcatcaaattcagcgtccccactatttttatcaacttcttcggcttccttatcttgtgtatttactgtatcatggacagattggtgagtgccaggtgcatttcctgaattgtcaaacgtcaccaatgaatcaggatggtgagtagtaatactttcgttgacgctagcattcgaattccttaacacaaaaaacacaacaatgagcagtaaattagttattaccaagactctcacgtttcttttgtttataacaatagccatctctaattttcttcagttgttttgcgtttaatttgaaaattttgcttctttccaatatataggttttttcttttatttgattcgagctttttcactgaggggatatgtacacattggcaaatatcctgccgaaagtacttctttattttttttcaaaacgcagtcccacttaccggtatgacgtagtctcgattctcaaatacacccgggactgcatatttatacatctgtagtaaagtcattttatatggattgtgaaggaaaaaatttacataactggaagataaataaacataactatgtaaggaatagtaataagaatgtagaaaacgccaatggaagttgtccaaactatagtccgacccgttgcatattatttaccggcaatcgccttatcatgagtagattctaaaaatgctaatctatcggtgatgtaaccacacactcttttccattccgttttatcctgccctaaaaggtcatcgagatatttgaaaggattcttattaacacaaacatattcgtttaaaaccttgaaattctctagttcaatatcgtaattttttaccttttttaaggccgtatatgaacgagcaggtttaccattcgtagtcaaaaaattgcttttagataaatcgtatgggtcaaactttgggaagtttgaatggatgaacataacatctacatgattcttggcatttaagtcctcgttgtcgaaaaattcttcggtgtatttttcgagggaatagtttttgtcaaacttgattgcatcagctgatttagtgccaccgtatttgttgccaatgctctccatagcatttaagtaacggccataatcctgcacaaagtcgtgttgtaacattgctacaccatgaaacccgtcttcatcatggtagccttcaacgcctgtccttgttctaacttggtaaaatgatagaccataaaagtttgcagcggcaatgaaagtttccttatcaccttcaccagcagctttttgagaaaatattgggtagtaccacgttggtccattgacgttgtagaataaagatagaagagccgtagccaaatgcttcgttttgtttatcatcagttggccggattccgtagacacgtcgggtattgttccgtctaggtcacttagcgggacgtcactcaaatccttcaaatcctttgtgtaaacagcaggtggggtgatatcgtctcgagaattgcgaactctctttttcttgtccacagcaatacctgcaatgtcgtaatacaatgggtgagttgtacgcctccagaaatcgggccacatgaccaagcccgtagacacatatggttcttcattgaatatgttgtctaggggtttgatggggaagttgtcagcatccagtaagagcaggttttcaaaactagaagcgataagggccaatgatttaaactggtatcctttgaaaacaaatttttcaatcgtctctcgtggtagaatatctgaaacgtaaatacacttggagttatacttaggcagaatcttgttacaaaactcagtttcaccttcatcaccaggagggatcaggacttccacaggtaacgtggtccccatattccttaaagtcttaatgatcaaaaatgccataagggagaacttcccgccacccactgtggctataccggaccctttgtacgtaccctttggcgagacgagagtcgctatatgctctacgtagtccttatggcttttggtcagacttgctacttcatccggagatagttccaaacacttggacagctccttagcagacaacttgtaaagatctttgtagtggtcgggacggtctccaatgtcaccctttaataagcatgcctcgttatactgctttgcagtactccccttgggcgaatcaaccattagaaagttgaaaacgttgttgtagaagcttttcaacttttcattgcctgcctcatcattgtccctcaatggggttgaatcgtcagcgctggcggcgtctgaggaagatgaatacttattggagtaactctggacatatctgtctaagtactccttgtactccttgaccgacgtgttctcatccatgtatttgtttgtaatgacgaacagcccgcacaatatcaaaactatgaacgtcagcttgaacagctttgaaaaccttttggtaagcagcatactgaaaatataattttactgacctacctacactgatttgtctcgaagtagatatgataccttgagcagcacgaggatattaaaaagtagggcaattctgcttttaacgtataagcaacaccaagtacacgtaatttattttgatgattcttctatattttttttttcttcattgttattttttcactatctttttcatccctccgcaaaaggacgcgatccttttttagcacgtgaacggtaataacgggtcctggacgatgtattagagtcacctaatcaccaagcgagccaatggcgactcacttgacttgcatgtttgcataacctatttagcgaaccctccaacttctgagcgcaccagcttaacttgtgcgctaagctgccttgcccgacatagtgccatcgctcattccacctcacacctgattaactaaaagttttaaaactacgggactgcgaaaaagtagagctacgttactgcagacctacaataattgcacacatcggcctgataacgaatgcttctaaaattctactgtgctactatcggctggtcgcgcccgacgggttcgctcagccgctctgcgccctcttactcttcagccattctgctgcggccgaagctataaaagtatgtcaatttggctttttccaaaatccccctctggctctttctcttctcaagacaagcattgaagagactcactagtaagcttaagatagtcctacacacaaccaccatgtctgctaacgattactacggcggaaccgccggcgagaagagccaatattcccgtccctccaacccgccaccttcatccgctcatcagaacaaaactcaggagcgtggatacccaccccaacaacagcagcagtactaccagcagcagcagcagcatcccggatactataaccaacaaggatacaatcagcaagggtacaatcagcaagggtacaatcagcagggctacaatcagcagggatataaccagcagggatataaccaacaaggccatcaacaaccagtctacgtccaacaacaaccaccccagaggggtaacgaaggttgtctggctgcatgtctggctgcattatgtatatgctgcaccatggatatgctattctaagagaacccgcaaaagtattcaagaatgaaaaaaaaaaaaagaataatctccccttctgttctttgcagttgcctttcttcccctcagtgttattttttttcacaaggagataaaaaaaaaaactttaacatgtcactttaagcatgtatgtaatacgtctattaattatatgtaacttttataactattttcatttctatgtgatccatttgcagttatgcaccttttttttttttccgaattgtgctatgtatatatcactagtaataatgtaccaaactatacaaacacgtaggatacagtaaaaaaaattttagctggtgaactgttgtaagaaggagatttcatcgggcgtgaaatttattgcagaaatttgggcagaatggttcatcaaaaaggtgtagatctcttgcgcaaaaacattcgcctctacattgcttgaaaggcccgtaacaattttatgaatggtatcattactcattgtgacctccgtgctggtcaaattgataattttcaggaaacccatgtacgcgctactcttttcctctacatcgtccaatgcgttaacggacaaacaccatttattccagttggaatcattggcaaatgcgccagaactgaaaacttcagggtgtgttagccccatttttccgatggtcacagacaagttctccatcacagagctgtctacgatttgtgtgttggtggtaaataaatctagaatgattctagacatatcaatgatataagtattcaaatcgatacgttcgcttatcaaaccaagcgcccatatcgcatttatcacagcaggagtaccatcactatcgtcgttatgcattatttccgtaccaatcaacttcaagaaatcctccaaattaccaattaccagttccgaattgaaaaaatatacaatatctcccaacagggcaaagcagctttgtcttacttcatggacagggtcctgcaaacattctagcatgattttcaatatcgttaaatccttcgtcccttgagggaacaatagatcctgcgagtgagcgccaagaccttgtaccaatccatcaatcaaatctaatgaggtgatgatgaagtccttctcaggcactactattgtcgggtcttgatgtgatttggcttccaattcgacacaatgacatagaattctaaaggctctgttgtacacttctggtgccataggcatgaatctttcccccagtgatgatgccacgcaggaaagacattctaaaagtggccacagctccttgtcactgtctgacagcaaagcccatttttcaattaagggcggcaaaattatttgcatcgctgtctcgtctaatgcacatttttcagcaaacctgccgatggcatcatataatataattaaattctttttcttgtaatatttcaaacatttatcaaaactcgtcaataattgactataaaataaagtttcaaccaattcggagtcggcgttttcaataaatactgctacactactaatagccgcctcttgaacatcctttttcttgtccattaatgtgtttattataggttctaagactggaattaaaaactcagtatggtcttgtaatatccatggtgaaaacctacttaatgtccaacatgtcattttcctcactggtgcccacttatcgttcaattgttccactaaaaatggtattagtgctggtaagccatcattaaaatacttcattccaccttctgccatggcccccagtgctaatatagtagcttctctaataaaccacctatcagaacccaaatgttctcttaaaaatgggaacgctatatccatcacttgatgaggtaaaatattcgtcattacatctagcgttgccgcggaacattttctcaaattccattgcgtatcaacatcgccatcttcatcatcatcatcatcatcatcatcttcgttgtcatctgcatcctctccatttcctgcctctttctttttcacaatacggggtgcaatgggcttgatgtcctcatctttatcctccaagaatgcatcatcatcattagaagcttccaggagaacgatggattcttcgttatagaccattttcgataataatattggcacgatatccttaacatatggttgtaagatatgttcaggaatatttgggctcgttgcaaaggcgtgcaaaaactcgcaggcttcaatagccactttttcctcatttacagtggtgatcaaatgcaacatgaattgtacaataccatctaaatgggaaaccagcttatctggtctgaattccaataagaaactaaaactaatgcaaatctgtgccctaactaggtcgttttcgtcgttttgtgccaactgaaaaataatttctaagaatttatctaatctcacaataaaactttgtgtttgtagcgggatcactgtatttatacatttcaccgattctgagcgaatcacaggtgagaaatttggattcgaaataaacctaaaaaaactatccaataaggcttccataggcttcgtatttcccgaccattccaattggaaaaattgagcgctgtcttccatgatcttagataaagccttaatacttggctcatttccatttgaggttagctctagcaactggtaaagcatttgaagaccagttggatcatctctatgctgcctatagtaagtggaaaataaagtagtaataacgatacctgtcacgttcgaaacgagattattgttcgaattataaaggccatgtataatgtttgatttgacgtatcctaagtcgtggctattgctcttaattaaattgtttccccctagcattgaatttttcaacagcataccggcggtagctctattgttctgaagatcctgtagggagtagtgttgcttcaatacatcatcagattcgccttcaattaaaatataacacaaataattgagaaattcaggttgcagctggaagttctccatagcttccattgcgttattacgaatctctggatttggtgacatacagttctgtaaaagagttgctagttgcaacacatagtcttcggcgggcttccatgtcgatgccatctttattcacttaactactgctaacaattctgaaaaccaaagactgcggaatattctgatatgtattattactattcactgctcttctgcataattaatactgaaaagtttttcatacttttaaacataacctttttttaagcaaaactctataacccggatcagaaaactacgaaaagagggtaataacataggtgcaggatttccatcgataacgacaccgacaatgagccttgctgcaacatccaattaggactaataactatcgtaggaatttctacgtaataaacttcaacagagcctaaaatttgaaaataaataatctagaggggaaacttaaagaaattctattcttgtcaataaagtggaaatgtgtcagatgtcacagtttctttatttgtgacacatattttcaacataaattcaggcattagtgcttttataagcataagaagttgtggcgatatgaatattccagattttacttacaagctgcattgtattcctaaaattcttttttctttttttttttttttatggaaaggaccactcttacataactagaatagcattaagaatcagatttacagataatgatgtcattattaaatatatatatatatatattgtcactccgttcaagtcgacaaccaataaaaaatttaaaagaaaccaggcagttaatagaaaaaatatgatatgaatgaatattccactttctttttacagtctttgtagataatgaatctgaccatctaaatttcttagtttttcagcagcttgttccgaagttaaatctctttgaggctcacctaacaattcaaaaccaaccaagaatttccgaacagtagctgatctcagtaaaggtgggtagaaatgcatgtgaaaccaactattactcaattcatcaccagtcgcattcaaaggagcctgatggatacccattgagtatgggaaactcgtttcaaataaattatcatacttaatagttagttgctttaaaatcgaggcgaggtcctccttcaccatttggttaaattggctaattgaggcaagcttcttctttgaaatgaccaaggtctcaaatggccagatggcccagtatggaacaacaacaataaaggattcattctccactacgactcttgacttctctcttgattctaatttgacgtaatcggcaaacaaatcagtattgtgttcacgtttatatttatcaaaagatttcaattcttgcgaaacttcactagggatggattctaagcaccaagcttggccatgtggatgtaagttggaacaacccatggctgtacctttgttttcaaatatttggacatatttgaaaggcttatgattttctcttgcttctctggagagatcgtcagtcaatgcttgccaagaattaacaatatgaaccagatctgattgtttcatttgtggaatggttagattatgattggggctaaaacatatgacgaaacaattgcctctcacagattgcactttaagcagcctatttttaagattatcctcattggaatcattctgtggtaaaataggttgatcgagcctaacggcagcataatcattggggaaaatatacgttgattcatatcttgggtttaggttaccagtagctcttttgttaccaggacatagatagcattttggatcatacaatggagctgtgggcttgtaagcagcctcctgttgacctaaccaaggtcttttagctctgtgtggagaaactaagatccatgaatcggttagtggattgtaacgtctatgggaatggctagaaaaatcaaattcttcagcagtcatttttgagggaatattcaactgtttttttttatcatgttgatgctctgcataataatgcccataaatatttccgacctgcttttatatctttgctagccaaactaactgaacatagctacacattattttcagcttggctattttgtgaacactgtatagccagtccttcggatcacggtcaacagttgtccgagcgctttttggaccctttcccttatttttgggttaaggaaaatgacagaaaatatatctaatgagccttcgctcaacagtgctccgaagtatagctttccaaaaggagaggcaaagcaatttaagaatgtatgaacaaaataaaggggaaaaattaccccctctactttaccaaacgaatactaccaataatatttacaacttttccttatgattttttcactgaagcgcttcgcaatagttgtgagtgatatcaaaagtaacgaaatgaactccgcggctcgtgctatattcttgttgctaccgtccatatctttccatagattttcaatttttgatgtctccatggtggtacagagaacttgtaaacaattcggtccctacatgtgaggaaattcgctgtgacacttttatcactgaactccaaatttaaaaaatagcataaaattcgttatacagcaaatctatgtgttgcaattaagaactaaaagatatagagtgcatattttcaagaaggatagtaagctggcaaatcaggaaaatctgtagacaatcttggacccgtaagtttcaccgtttttcaaggttacacaatctttccagttctcttgattgatagcatcaatgtatctaccaggctcaattgcaaaaccttgtcttgcttcgtaaccagcagacaagaaatcaccggtataaaattgataagttggctctgtacttaaaacttctaatgtaatattggaatcgggatgaaaagccttgacaataagcgtcaattcattgtttagagtattgatttgacttggcttagcattttcatccaccacaaaacaacaatcaaactggggatttttggggcctaagaccgttggctttgtagagttaaaggtagcaatttctctatcgacgatattacccgtaggaatcatgtttttgtcgacatcaacagatttttttgaacgcaccataatctccgtaccctcaatagtgtctccatatggcttgttcagattgaaataactatgatttgttaaatttattggcgtcgcttcaccagcagtcaatttacctttatataccatttccaaacttttttgggcaacgttcacagtatactgtatggttaccaatagatcacctggaaattcggtgtccttctcattatctatcagcatgtactcggcggtaaaaacatcctttgaaggattttgaatgatgggtcccaaaaatctttttctgtggaaagaaccgatactactatgattcgcattaacgccgttattaacggttaactgatagtctttgttgcataaactaaacttacccttcgaaatacgattagcatacctgccgatcgtggcgcctatataagcactatcaggattcaaatacccttcctcattttcatagccaagaacaactgattgtccgttcactttcaggtcaacaatgctggcgcccaaattggcaaacgtggcttgaaatctggtgccggcaccaatagtcacaaatcttgcgtcataacgcatatcttcagcggaaaatctggcctcgacaccccttaactggtaaccaaaaggattctcagtagtccatttccataaatccttgcaggagtcttcaacctgcaactcggtctgccatttcagttcgcgtttggccctatctggtttagccgtcaagttcaaaacatcacctgctcttctgcccgtaactttgtatggaagatcaataccagaagctttgcagaatgcatgataaacttcaaaaactgtagaacctttaccggaacccaagttccactcacgacacaaaccttcattttcattgtaggcctctaggtattgcagggctgcaatatgaccttttgctagatcaactacgtggatataatccctgatcggggtaccatctctggaatcataatcgtctccgaagatgtaaagcttctcgcgcctaccaacagctacttgagccatatatggcaacaaattgtttggtatacctagcggatcttctccgattaatccagagggatgtgcgccaattgggttaaaataacgcaagatagcaaacttccaactttttttgtcgctattgtaaagatcattcaagatattctcaatggcgtatttcgtatgaccatacggattagtaggccctaagggacattcttctgggataggaatcatatttgggaatctcgtagcatcaccatagacagtagcagaagatgaaaaaacaaatttggaaacgttgtattgttgcattaactctaataaaacgacagttcccaaaatgttattgtgatagtatctcagcgggatttgtgtagattcacctacagcctttaaaccagcaaagtgaattaccgaatcaattttatattctttgaaaaccttttccagaccttttcggtcacacaaatcaacctcatagaagggaatgtgatgcttggtcaagacctctaacctggctacagaatcataagttgaattcgacaggttatcagcaacaacacagtcatatccattctcaattagctctaccacagtgtgtgaaccaatgtatccagcaccacctgtaaccaaaacaattttagaagtactttcactttgtaactgagctgtcatttatattgaattttcaaaaattcttactttttttttggatggacgcaaagaagtttaataatcatattacatggcattaccaccatatacatatccatatctaatcttacttatatgttgtggaaatgtaaagagccccattatcttagcctaaaaaaaccttctctttggaactttcagtaatacgcttaactgctcattgctatattgaagtacggattagaagccgccgagcgggcgacagccctccgacggaagactctcctccgtgcgtcctcgtcttcaccggtcgcgttcctgaaacgcagatgtgcctcgcgccgcactgctccgaacaataaagattctacaatactagcttttatggttatgaagaggaaaaattggcagtaacctggccccacaaaccttcaaattaacgaatcaaattaacaaccataggatgataatgcgattagttttttagccttatttctggggtaattaatcagcgaagcgatgatttttgatctattaacagatatataaatggaaaagctgcataaccactttaactaatactttcaacattttcagtttgtattacttcttattcaaatgtcataaaagtatcaacaaaaaattgttaatatacctctatactttaacgtcaaggagaaaaaactataatgactaaatctcattcagaagaagtgattgtacctgagttcaattctagcgcaaaggaattaccaagaccattggccgaaaagtgcccgagcataattaagaaatttataagcgcttatgatgctaaaccggattttgttgctagatcgcctggtagagtcaatctaattggtgaacatattgattattgtgacttctcggttttacctttagctattgattttgatatgctttgcgccgtcaaagttttgaacgagaaaaatccatccattaccttaataaatgctgatcccaaatttgctcaaaggaagttcgatttgccgttggacggttcttatgtcacaattgatccttctgtgtcggactggtctaattactttaaatgtggtctccatgttgctcactcttttctaaagaaacttgcaccggaaaggtttgccagtgctcctctggccgggctgcaagtcttctgtgagggtgatgtaccaactggcagtggattgtcttcttcggccgcattcatttgtgccgttgctttagctgttgttaaagcgaatatgggccctggttatcatatgtccaagcaaaatttaatgcgtattacggtcgttgcagaacattatgttggtgttaacaatggcggtatggatcaggctgcctctgtttgcggtgaggaagatcatgctctatacgttgagttcaaaccgcagttgaaggctactccgtttaaatttccgcaattaaaaaaccatgaaattagctttgttattgcgaacacccttgttgtatctaacaagtttgaaaccgccccaaccaactataatttaagagtggtagaagtcactacagctgcaaatgttttagctgccacgtacggtgttgttttactttctggaaaagaaggatcgagcacgaataaaggtaatctaagagatttcatgaacgtttattatgccagatatcacaacatttccacaccctggaacggcgatattgaatccggcatcgaacggttaacaaagatgctagtactagttgaagagtctctcgccaataagaaacagggctttagtgttgacgatgtcgcacaatccttgaattgttctcgcgaagaattcacaagagactacttaacaacatctccagtgagatttcaagtcttaaagctatatcagagggctaagcatgtgtattctgaatctttaagagtcttgaaggctgtgaaattaatgactacagcgagctttactgccgacgaagactttttcaagcaatttggtgccttgatgaacgagtctcaagcttcttgcgataaactttacgaatgttcttgtccagagattgacaaaatttgttccattgctttgtcaaatggatcatatggttcccgtttgaccggagctggctggggtggttgtactgttcacttggttccagggggcccaaatggcaacatagaaaaggtaaaagaagcccttgccaatgagttctacaaggtcaagtaccctaagatcactgatgctgagctagaaaatgctatcatcgtctctaaaccagcattgggcagctgtctatatgaattataagtatacttcttttttttactttgttcagaacaacttctcatttttttctactcataactttagcatcacaaaatacgcaataataacgagtagtaacacttttatagttcatacatgcttcaactacttaataaatgattgtatgataatgttttcaatgtaagagatttcgattatccacaaactttaaaacacagggacaaaattcttgatatgctttcaaccgctgcgttttggatacctattcttgacatgatatgactaccattttgttattgtacgtggggcagttgacgtcttatcatatgtcaaagtcatttgcgaagttcttggcaagttgccaactgacgagatgcagtaaaaagagattgccgtcttgaaactttttgtccttttttttttccggggactctacgagaaccctttgtcctactgattaattttgtactgaatttggacaattcagattttagtagacaagcgcgaggaggaaaagaaatgacagaaaaattccgatggacaagaagataggaaaaaaaaaaagctttcaccgatttcctagaccggaaaaaagtcgtatgacatcagaatgaaaaattttcaagttagacaaggacaaaatcaggacaaattgtaaagatataataaactatttgattcagcgccaatttgcccttttccattttccattaaatctctgttctctcttacttatatgatgattaggtatcatctgtataaaactcctttcttaatttcactctaaagcataccccatagagaagatctttcggttcgaagacattcctacgcataataagaataggagggaataatgccagacaatctatcattacatttaagcggctcttcaaaaagattgaactctcgccaacttatggaatcttccaatgagacctttgcgccaaataatgtggatttggaaaaagagtataagtcatctcagagtaatataactaccgaagtttatgaggcatcgagctttgaagaaaaagtaagctcagaaaaacctcaatacagctcattctggaagaaaatctattatgaatatgtggtcgttgacaaatcaatcttgggtgtttctattctggattcatttatgtacaaccaggacttgaagcccgtcgaaaaagaaaggcgggtttggtcctggtacaattattgttacttctggcttgctgaatgtttcaatatcaacacttggcaaattgcagctacaggtctacaactgggtctaaattggtggcagtgttggataacaatttggattgggtacggtttcgttggtgcttttgttgttttggcctctagagttggatctgcttatcatttgtcattccctatatcatctagagcatcattcggtattttcttctctttatggcccgttattaacagagtcgtcatggccatcgtttggtatagtgtccaagcttatattgcggcaactcccgtatcattaatgctgaaatctatctttggaaaagatttacaagacaaaatcccagatcactttggatcaccgaatgctactacttacgagttcatgtgtttttttatcttttgggctgccagtcttccatttttactggttccacctcacaaaattagacacctgtttactgttaaagccgtcttggttccgtttgcttcttttggtttcttaatttgggctatcagaagagctcacgggcgtattgccttaggatctttaaccgatgtacaacctcatggctctgccttttcgtgggcttttctaagatcactaatgggttgtatggctaatttctccacaatggtaatcaacgctccagatttctctagattttcaaaaaaccctaactccgctttatggtcccaattagtgtgcattccatttttgttttccatcacttgtttaattggaattctagtcaccgcagctggttatgaaatatacggtattaattactggtcgccactcgatgtgctagaaaaatttttacagactacttataataagggcacaagagctggtgttttcttaatctcttttgttttcgccgtagctcagttaggtactaatatttctgcaaactcattatcgtgtggaactgatatgtccgctattttccccaagtttatcaatatcaagcgtggttcattattttgtgcagccatggcgctgtgtatttgtccatggaatttaatggcaacatcaagtaaatttacaatggctttgtccgcatatgctatctttttgtccagtattgccggtgttgtctgctcagattactttgttgttagaagaggatatatcaagctaacacacatatattcccatcaaaagggctctttttatatgtacggaaacaggtttggtatcaattggagagctttggctgcatatctatgtggggtggctccttgcttgcccggtttcatcgcggaggtgggcgctcccgctataaaggtttctgatggagctatgaaactatattacctaagttactgggtaggatatggcttgagtttttcttcttatactgctctgtgttacttcttccctgtacctgggtgccctgttaacaacattataaaggacaagggctggttccaaagatgggccaatgtcgatgattttgaagaagagtggaaagacacaattgagagggatgacctggtagatgacaatattagtgtctacgaacacgaacacgaaaagactttcatttaagctctccatatctacatcactttctgcattaatctgaaatatttttcaaattttcatgtgtaatgatattaatccttatctatactacttacttctatttacgttctctttagcatttactttgtgcatttggccttcaatgagcattaatttcactggttttaatatattcactcactttcattcgattttttgtttgctttatggcttagcgttctttcctctctcctttctctttttacacacgagaaaaaatggataattgttgtattatgccatatgcataactttacgattcgttatgctatgcgaacttgaagcccagatttctacacgaaaagtttgagtttattagtatcttctccaagataaatatagcatcaagttacaggtatgtcgaacatcacttatgtcaaaggtaacatcttaaaaccaaagtcatatgctaggatcctcatccattcttgcaactgcaatggctcgtggggtggtgggatcgcttatcaacttgctttgcgctacccaaaagcagagaaagattacgttgaagtatgcgaaaagtatggttctaatttactaggcaaatgcatattacttcccagttacgaaaactcagatctgctgatttgttgcttgtttacatcatcatttggaggttcaagtcatggagaaaagcaaagtattttgaattatacaaaacttgctttagataaattgaagacctttagagaagcaaaagacaaaactcgaacaagtgaagattcaatcggtgactatttaaacggccacatcaaatacccaataggggaatataaattggaaatgccacagataaatagtggcatattcggagtcccttggaaagagacagaacgcgtgttagaagaatttagtggcgacatgagttttacagtatatcagctgtaattgccttagccacgtaatatgtgcctttaaagatagagaaatatttatttattaagttttagttctaaggtgtgttaaaatacctctcaaataaataagttacacacaaccatatatcaacttgtaagtatcacagtaaaaatattttcatactgtctatgcaacgaaggagtcactttcctccttccgattgagaatatcttccctttcaaattccctccatgtcctcattttaatctttgagtgatcaaattcaccttcattctcgtcttgtgcctttttattacctcccgcaatagttctcgtatcaccccatgagaagtcatcaaatttccagtacgcatatgaaggtagtacgaaattccaaataggcaaagcacaaatatatacgcacatccaccataggtacgaccatctcgtagcagttataacaacaattaagccgggcagaccaagaataattgccagtaaaactaaagtgattacgggtgtaggttttgatacaatggcaaaaataatgacataaatagtaaagcaaatggctaacggcagtaccatagtaccaatcaattcaataccaatcacaaattgcatggaaaaacagaaagtgccacataagtctctgattagaactaattcaaaaaggttatgtaccgtagaattaatccatcttcgacgctgggaaagtaagactttgaatttatcaggggcaatagttttacaagcagcttttggaacaaatacttgctttctcttagggaaagtctttaacattaatgaagataaaaatctatcttcaccaagtaataataagttcttcttatgcaaagtgtttgtaacattatccgaatatctttcaacaatatctggatttgccaatacaggtacccaataaccatctgaacctttaggagattttatacgatacattgagaaacatcccggcaaacaagttaccgaaccgaagacagattcaaaagctttagcctgatgatgcgaaatatagtactcaaacacttgaattgcagttacccaagattgtgccttattagcgatcttggtctcaccacaaagacccataatcaaaggatctttaaccatttcagcgaccatatgagttaaagcatcgggaaagactttagtatcagcatcaaccataagtaccgtttcgtagaagtctgccattagccccgtaatctgccaaatattttttaaaagctgaaattccaattgagtcattctttcatcaaatgttattttttctaaaaaggacatcagaataatttgagaatcacgcttacctctgttaccgggtttggcggccccctgctctgcaggagtaccgcacttcacaattgtaatgattgggacacgttgttgattttctggtggaattgtagaatcgtcatatttgtaaaaacccgcatatatcttggccatattgtgtcttttagagcctgatgccactgccacataggagtaaggtttaacttcatcaggtggggtgacaaagtcgtccatcattcctaacgctatctctggagtagtcttatcgttgcccgagcccttaattaaaccatcacaaacaaccatcagtagtttatgggaatttggataatctgtggtagaaagagagtctaaagtggttcttaaaccctcttcatcctcagaataacaagtaacaaaacagatagtatgaatcaatgggaacccgtatggcataaaatccagtggtggttgttgaacgatatcgggatgtataatcgtcgaatcaagactctgaatcagcgatgatcctggtacaggagaggaagtcgctttattccaaaacatcgaggatgtaggcaacaaagtagatggattacgggaatgtacagctttgttttcattcgagagtttccaagcattttgagtggtcattgttgtcattcctctgtatgaaccagaagattgtagtgaactgctcatggaggtgtctagatctatcacagattcgttaaattgaaacattttggagctgtgttttttcagcaagtcaaaggttgaagcacgcttgtgtcccaacgacttttttgagtatttctttggcctcaaatgaggatctacttcctttagaggagcttttgtttgaatattattagaccaatcctcgatatcgtttgtgtgtttatccattgttttattgtccacgatatatgcaccttgtttcctagctacagtccaacggaagtagcaggcaattatgaatttaattatcaccactgaaagaataaataccagagaaacatacaaaacgacatcagaggcaatacaaccgacggttttggagtctacttcaccaactttaataatttcgctcaaacatctcgcaatttttctttcatgcccatttgacaaaaccaacgaaagatcataaccttgtaaatttgaagtcttcaagtcatcgaatacaacgggatagtcaacgtcatccttttccaaccaatcaagaagatctaaatccaaaacgtcgccattataaacaatcaagtttctagaagagttctttataccatcccaagtgaagtaaacatcagctttcgactttaaaccgtaaaatgcgtccctatcttctttagacgtatgacagttccatcctgcgtaattttcaactgtgaagtttggcttcgaagagccatcttgattctttaacttacaaggaaaataccatgctaaattattatcatcgtcatggggaatggaagaattactctttggagttataaggttatgacagttaccattcacattttgaaacaagaacgaagcatctttaccagcatctgaccagggcccataaagggtgtctgaatctacttcaacgtcttgtataccggaacgcgaggaagtatccaattcataagccttaccgttaattacgacaaattctgttgatacttcgttgtttttcaaacgtagtttcgaactactacaaacggttttagtgaaaccaaaagtcaggaaagccacaatcgcaccaatgtacaagatgacagaaattaaagcaaccttttctctccacgccatttgtctttccttctttggcatcccgcagaaagcaagaattggagcaggtgcccaaaacgtaatgaaataacagtacatctgccaaaatgacaatgtatcattcgtttcctttcttaatggtttgatagacttatttatgggctgcgtggagctttcttcgaaattgtccacatcaccatctttatcaaattcgtcttccgcaacaccttcatcacttattttaacggaagccttcttgtcagtagtattcatatcttgtaaaagatagctatccgtttcgcggccactaaatttgcttctcactgagcctttggagcgcagggagccactccgacgagttgcatttgggtttacaccggtacttgatggtaaaacatccaggtgattcatctgctcctgcgttttctgcgcataataaaaatgtggattatcaggattgttcagtcggcttctttcgggccgcactaaagagccttgtctatgaggtgctcctgagccgacactgtgtcttgacctaagtagagactcttcatcttgattaaggttcagatagtagtcatcaggatcatctccattcaagccggtcattctaatttctttcctgcggatagtctaaacaggacctttgaagaaaatgggacctacaccaaaaatactcgagaactttgcaaatcggtaaacgtttataaccgtctaccaatgtgattcttctagcaggatttactacaagtcgaaatgttggtactgaatgtaaatctgaaacacaggaaagaatatttttgatttctatttttatgctcttattttcatttttgattttttttttcgaggtctgcgccagcgccaataacgcgttttatccaaataggcagccaaagagggtcacctatgcaggtgctgaatgcaatacaactgcgggctaactgtccatcgacgctattgaatatgcttcaagaaatatccagtctcatgcacatgtcaaatatgtgggtgagggcgcaaatacaacgcacgattatatatacatttgtggctacgtagtacgtgcggagataggcaggtatttgttcaaggatgtaaataagaactacaatgcttagttctcgaatcctagaatgtgagtaaatctcacaagcaccgcttctataaatttgtctagggtaatttgtaatcttttcccatgcggattctcttaaatacggtacagccgtcgctgctgcggtgtgattctggtttcatagatctggaaaaagaaagcgagacacaatacaagagctttgtgacacagcgtacggagagaataagataaagaacagttcctggcgtttttaattgaacttttgtactcgtctctttattctcacgaatttttttaccgccgttttcatttccattgcaaaggagggaaaatataaatgtttttatagaggcagtatatctttaatttcatagcatatgcagtttagaaaaaagacgtaaattcgttgccctagtcacgctggttacataaattggtcgttgaattgacttttaagacatccagttggtgtgtttgctccaaatagtgctgacgcatcttgccaattctcgtcaatttagcacggaatgcttgttacttattcgataacgcttttaccttgattgcatgtagtcactatcctcaaaccttttctaaggttgccctattggcgacagaaaagcaggacgagaaatctaaataaccaacgtgtggtttattaactatgacggttggtttgcttgccgccccaagttatagaagactgcccttcatcccggggtagctatcatagaatctgtcgatagttacaattttgggtggggtgttttcaaaaatggacggatatgccggtctttgaaacttcgatgatgtagcctattgttttaattttctgcttgatcctttcgctctttttagggataaaaaagaaaacctaacaaagtatgaatttcgagaagtcccatcgatagtagtcaaacaattgctaaagagggctacggatcgtctacaataccttcgtaaaacagcagcttacaggatcttttataatatcaccatagaaaggggaatttgggaagcgagagtaaaatgttgaatagttcaagaaaatatgcttgtcgttccctattcagacaagcgaacgtctcaataaaaggactcttttataatggaggcgcatatcgaagagggttttcaacgggatgttgtttgaggagtgataacaaggaaagcccaagtgcaagacaaccactagataggctacaactaggtgatgaaatcaatgaaccagagcctattagaaccaggttttttcaattttccagatggaaggccaccattgctctattgttgctaagtggtgggacgtatgcctatttatcaagaaaaagacgcttgctagaaactgaaaaggaagcagatgctaacagagcttacggttcagtagcacttggcggtcctttcaatttaacagattttaatggtaagcctttcactgaggagaatttgaagggtaagttttccattttatactttggattcagtcattgccccgacatttgtccagaagagcttgacagattaacgtattggatttctgaattagatgataaagaccatataaagatacagccattgtttatctcatgtgatcctgcaagagatacaccggatgtcttgaaagagtacttaagcgattttcacccagctatcattggtttaaccggtacgtacgaccaagtgaaaagcgtatgcaaaaaatacaaggtatatttttcaactccacgtgatgtcaagcccaaccaggattacttagtggaccattcgatatttttctatttgatcgaccctgaaggacagtttatcgatgcgttgggaagaaactacgatgagcaatctggtctcgaaaagattcgtgaacaaattcaggcgtatgtgccaaaggaagaacgggagcgtaggtcaaaaaaatggtactcttttatcttcaattgagcaaaaaaaaaaagaaaaagacacagctaggataccgaacttatgggtcgttcaatttaacagttacattgtaaatagaaaaaaatagtaaaaaaaatgaaagtcaaatgattatgcttgtcagttcaaattattaattgggcttaagggcgtaaacatgcgggaataataaacatacatacacacatacataaaatccgatgccatccactcgcgagattgcttttttcctttcgtttctctttcaagaaaatcatgttgaaaatttctatgatgatatatagtagggaactaaaccaaataaagaaaagtcaactttagtgcacgaaatcaattcttaccagcaccagctctgaagtaaatgatatcaccgtcttcaacgacatagtctttacccttttgcatcaacttaccagcggccttgatggcagaatcgtccttatattcgaagacatcttcacatttcataacttgagccaaaataaaggtattcattaaatcgttatgaataacaccagcagcttgtggagctttagtacctcttctgatggtccattcacgaacttcatctggaccgcaggtgaaaaaggaaatcaaatctaacttttgtctcatggtagtgataatctttggcaaggcagatattgtctgcagtttcttcaattcttcttcagcatcttctggggacatatgagatagtctttcttctagagaaacactgaatggaatgatcaagtcacctggagagtacttgtctacccattccttgattcttagcagatgcttgtttttctttctgatgtaatctctttcagataaattaatcaaatagatacatggcttagcagtcaacaagaacatggagttgataatttcaacttcttttgaagtccaggagtgattagcaactctttgaccactctctagcaatttaatgattttcgtaatcaaatccatttcttccttcttttgtttgacttccaaagattgaccacctcttttggcaatcttttcagcaccttccaaagccttttgtgcgaattcaatatctttcaatcttagttcttggttaataatttctaaatcacgaactggatcaacgtcaccctcaacgtggataatttcagcatcatcgaaacaacgaacgacttggtagatagaatcgactgatctgatgtgagacaagaaagcattacccaaaccttcaccagcagaggcacccttagtcaaaccagcaatatcgtaaacggtcaaatgagctggaacttccgaagctgtcttcttgtagatttcacacaacttatcaaatcttggagatgggacaataacacgggcttcttctggatcaatggtagcgaatggatagttagctgggttacccaatggacatctagtgatggcttggaaaaaggtagacttaccaacattggccaaaccgacaataccggctttcaagttattacctggacgacccaataagacctttttttcttcgacttgcttctttggaggcatgttttacagtgctatttatttgattgtttttacggatactagaagtaacacaaaaagctaaaaaaggcaaaatgcaataaaaaattagtactaattatcaactgaatacactactaaatacgatttctcgcaacgaaaggtatgagagagaagacgtaagttgactttcactgcatccttccttttgggtcataaaatcgctgggatggcccttgaaaaaattttttcagtgaaaaaaaaaagaattttcgagaaaaaaaaaaaattaggaattgtgcgtggtcattcaatacggagaattaagtaacacgcaacaactgcattctgccttagttgtctcaaggcaaattggcaccaacaatatgaacttgttgtaaagctcaactccaaagaagggaaactactcagatttgttttcttcagtttaacaggcgtatcttctgcaaatctactacgtttcctaccgaagacttcgctctacgagaattcttaggtttctacgagttacgcgcccttcttcgaacgccattctcaggaaaaattgcatttacgtaatcttttgttctaattgatataatggctatttatacgtaatatcatgcttaagaaccaagaaagccaataatggcattcggaggaagcaatcagtgaggaaaattgttgattaagctagatatttctatatctagtagatcttgtcaagttgaagtagcgaataggactcctgtattgctattgtgatgtttttttattgtacagtagttgtataacttatcgttggtattaactaccgtttgtttatacatcatgctcattatctcgtcctgactaatgtgaaaggatcgatatatacattgaagggtcgacgtccccttttattagctcctacaaagatagcactggcatatattttttaatgtcttggtatatattatatagcaactatactcgatgtcataaagaggaatactatctttggtggttgtctaactctgagcaatgctaaggcccttaccattctaaaacaaccatttttttcttccccttcccagttataccttttttgactagttctagtaactgttcgtcagtagtagtgttagtattccaggtaagagtttcaatttcatctcttggtgaaataatgtgaccataattatacattttgataaaatcactgatggtgtcaatcttgctttgggggttttttttgttcttttcagtcacccagtaccctttggatgtcaagcctttgaaaatgtgtagagatgttggtaaagttacaggttgttttgacattcctccataagtgagcatcaaagcattattttccaacttacgtgctattgatgcactggatttacctccaacagaattcaaggcaagcctcacccttgcattttcacccaaaatcttggacaatacttctttggcaaaagtcttgtcgttgttttgcgattcggaaataaccttcgtagcaccatacttatcctccaaaacttttgctacctcatcaaaattatcacggtcacgtataacacttaatgttttgatccctttagcttttgctacttgcgtaactatttttgatacactagatgtaccggcattttggataatccattcattaccgttactgttccagtcgatatagtctgatactaattggaaaccggtacaaccattaacagatacagttgccgcagaaaacagatccaaatcatttaccttgattaaatcagaactactagagaaaactctataattggaccaagtcccttgatttgcctgcaatgggataactcggtcacccaatttcaaatctcccttggaacttcccgaaggtaaagaaacaacttcaaagacaccctcattaccggcgatagcggctggctcatctgtggagtaatcgtatgtcttttctggacgagacgggtatactccttgcaactgattgatatccgaagggtttatgggaaaggccaaagtttttaacacaattgattgagataagtcttgtttaggcgtataatttttcactgacaaaaccttggtacaatcctcaacttcatgagttgaatagatgagcgatttgaagtgcttgggaatctgatgagctgaggacgacatgtaacgtttgaatgtgggaagcatcttgttatatcaaatgtaattggcagattatgaaccttcttaaatgacaatgtacgtttgtaatctccaatttctttagccatggaaacaacccctgggtacaccactcgtgcgtcccttggaggagaaccactcttttaaggtaaaaaaaaaagcaccggcggggtccaataatgataataataccataaataaggaagatggtatcaccgattggtccagaagtattatccatacagttgtttttaatattattacatacattatatattaaaaatgtgtttcgtaaccctaaagcaaaacaaagtatatacagtgacacagatcctttaaacatcaaaaaaacaaaaaaaagtaagtcagtgcagatccgagccttctctcttaatctatctaacttttaattcaaaagtacttctccaaatagctaccacttgctttataactaaatcccttgaacatatccggggacttgctcaccgaattgatattaatcggcttgctatccgtataggtttcctcatatgacatagaagtaaattctgtgtcaaaattttccgctagttccaaatccgtaataactggaacaattgggcctagagtggttttttgcaattgtccagattctaataacttccagtctatttttctaaagataaaatgttcagtgaaaagactagttcttgcagcccctgatttcttcttcttagacttagtaggcttattattagccccggttttggcccagtatttgtcaacattccaccttttggcagtttccttcttcaacagcgcgtttaatatatctttcattccctcgctcagataaaatggaattttggggccttgcttgttttgttgaatcttattaatgatcaccttatgattgctaccagtatatggaggcttacctactaacatgtcatacaacagacatcccaaagaataccaatcacaattctgactgtaagctttacctaataatatttcaggcgcacagtattcaggcgtaccgataatcgagtatagggcattgacgttctctggatcctcctcatcaaccgcggaatcattagcactttttttactcagaccaaaatctgtcaatactaaatgtccacgttgattcaataaacagttttcaggttttaaatctctatagacaacacctttcgtatgcaaaaatctcaaggcacagctgatttctgccgcgtaaaacgaaactgtcgtctcatctagggtcccgtgttccttcaagtggtaaaatagttcaccgccagggatatattgtagcagtaaatataactttgagttatcgtgaaaagaataaaataacttgacaatgtttggatgttctatttcagatagaatagaccgttcggcaaatgttctctcaagcctctttgataatccatcgtcattatcgttgttattaccatcatttttatcttcgtcttctctcttggaatctgtggctgtttgagaaattaaaatttctgctttccgtaattgcttcatagcatacagcttggatgtattgacgtccttaacaagaagaactttaccgtaggcaccttggcctaggactctcacgggcttaaaatcgtgcaggttccttgataattcattttctccaatattagaggaaataatgtcctgaggtgttatggatagtctattcgtattagttcgcattgcgtccgaacctgtaatagaaaatcttctcgtatttggtggagtgagaatagggaatttggaataagctgaggaccttcttctcatcctatgtgcaggactcatgccatttagcggaatcgcatttgaatgaaccgagaggtgatttatactctcctcatatgtgatggagctgccttgttcatgattgatatcattgtatattgccgaggaataatctactttaatgtcattctttttatcatctagtgacacacgatgaagttcttcatctagtgagaaaatcatcctaattactgccaacagtatgctcagctagattggttgatgaaaaatcttatcatagggcaccttccaggtaaaagatctacttactattagtcagtacgtccttttttcatttgtttataattttttttttttttttttttttctcctctcaatattttagaagtaacatgacagagcaacacgtttattttcctacatatagtcataagtataaaaacgagcgagaaattttgttaaagaattgatatcatattttataatttacataaactaaatagggaaagagtagtatagcgtgcataagtttgaaaaaaaaaaactattcatacactcatatatacttttatatggtcttttttatattcaagagtgattggtcaatgatttcttggtcacattaaagatgtcagccaacttttcaaaattcttcgctgatattataccttttttagataggaatctaatcaagatatcaatcaattctataatctgcttgtcgttcaggttcattaaaatagtggataaaactgtatctactgttattctgtgttcgctgatgaatgtttcatagtacaaattggcaaaagaacccattatgaattggcaatcaaccctgtctgtgataccaccatggcctgggatggagtggccaaagtctttaactttaaaagttctctttagaccagatgcgaaaaagcctccaaatggcgcaaataatgatgcaaaggtagctaagtttaaagcatggaaataaattggttttactgtaattgaattgatttgaactttatcgaaaaagatgggtggaagtctgtaaacttgtggaaggaaaactgggtttagttcacatgtcaaattagagaaaaaattggtatggagatcttcaacagggcacgtcaagtaagtataagggctcagaatccttgttaatataatactagctagagcagtgaaaaaccaggcaccaaggaaaccttctaaagttttcttgggcgagatttctattagtttagtcttaccgaatgtaatgccgcacaggtaggcgaagatatcattaacaattaccaacccgcatggtaataagaaccagaatagcccattgagcacgtttttgatgatcaaatgagcctgaaatactaccagaagaagaaccatatgagtaacgcacaatgatccgaactggaatttcaaaaatccctttcttaaactacaaacgaacagaacaaatcccataagatagagacaatagcagataaacttatgatttgttacgataaagttcaatacaggatactcgtaaaaagtagcttggaaaaacttgaagagtgatttcccatctaagtaatagatagtggtgaagagaaggtaccagttcaacgtctttgtcaatggcaaattcttttcgcgaccagatgcacttgttacggcaatacactctttaaaagtagcaatttggcagcccaaaatcagcactatacaccatgcatgacccgatgctaaggtgatgaagaaaccactgatcataacaaacgtccaaactgttctaatgaaaaagttgtatttcctgctttcctttgtagcagcagtgctttccttggtcaccggcgtgacggattcgctggcgtccttgtggagttcttcttgcaatttatcaatcgcctttgaggtggcgtcagtaaccgactccacaatctccttgctcgtaccatgtggtttcatctcagggttgtcagacattttaggtatatggaagtggaacagttaagtatgacaggttcgctgtttgggaagatacttggcaagaagtgcgtcttcacaatctggcttacactaaataacaatattgatgaatgctcccccatgctgtttacagttctcgattgttacacttttcacatgtcatcccatctgaaaaattttcaagaagggtatccgttgataatgactgtcaaatacatagcgatatagtaccaatatacagtgcctgaaaacgcctggaataagccaaagcgatcaaggtggagctcctgcagattggtttagaaagtagtgtattgatagttatttacatgggcgtttgtttatgattctttgtgcctaatatatccacgttctccgttgaattctgagatgtactgcatcaaaatagcgaaaaacgagcaataaatatcagaaaatcaaatgaagtatactcgatgaaggcagctgagatgaggtggcagatacaataagaaagatttgttgccatatataatagcaattaaaaaataaatttgaaagagtgagatgtccgtaacttttaaggacgatgttcatcggattctgaagtttgttgctaattgcaatggcaggtttgaagattccaaatgtgatataagagaatcgcctctcggtggattgggtgtctttgcaaagactgatattgcagaaggtgagtcaatattgacgttgaacaaatcctcgattttttctgcatctaacagctccattgccaatttgttatgtgacagtagcatcgatggaatgttagctctaaacatcgcattcatttacgaaactacagttttcagaaattctagtcattggtacccatttctgcgaactatccgaattcgtgatgacgaagggcacttaaacctgccgccaagcttttggcatgcggatgctaagcgacttttaaaaggaaccagtttcgataccttattcgattcgttggcaccagaagaagaaatcatggaaggatttgaaattgctgtggatttggcacacaaatggaacgacgagtttgggttggaaattccaaaaggcttcctagacgttagtgaggagaatcatgaagaagattacaatttgaaattagaaaagtttatatcggtggcatatactttatcatcaagaggatttgaaattgacgcgtaccatgagacagctttggtgcccatcgcagacctgttcaatcatcatgtttccgacccggatttaaagtttgtatcgctatatgatgtgtgcgataaatgtggtgaaccagacatgtgtaaacatctcatagcagaggaatacttggaagcagaaaatctagacaaaaatatgcccaaagtcgcaagtatggagactcgtgtcatcgatgaagacttaatcaaaagtttagaaaatgatttagagaaagaatactctaatgttacggcaaacatcgaggatgatgatggcggtattgaaaaccctgacgaatgtgtcgatttagtgttaaagaatgacgtcgcacaaggccaagaaatatttaattcctatggtgagctctcaaacgtctttttgttggccagatatggtttcaccgtacctgagaatcagtatgatattgttcatttaggacctgattttatgaaaatcttaaagaaagaagaaaaatatcaagaaaaagtcaagtggtggagccaagtcggtcatggcttgttttcagcatggtatgctcaaatgcgccaagaagatgaagaagacgaagacggtcaagcaaaatcagacaatctgtctgacgatatagagagcgaagaggaagaggaagaggaagagggtgatgatagcttggaatcatggctttcccagctttacatagactcaagtggcgagccttcaccctcaacgtgggccttagctaaccttttgactttaacggccgttcaatgggaatcattgttttccaaaaaggccactcctcacatcagtgattctatagttaacgaagaaaagctgcccttcctggccaaaaaagacaatccccattccaagaaactgctttccaacttacttaaggaaaagcaactaccttgcataaaaggcgacaactcgtcaaagataacaagtgctactaaaagcatgctccaaaatgctcgaacacttgtacaatcggagcataatatcttagatagatgtctcaagagactatcctaaataatattgaatatgcacttttactatattaatatcacgtcacacgacgcacagtgagaagtgaaaaattttttttcaatctgaaaaaaaaaaaaaaaaaaaaaaaaaatttatataaacgaatggtatctccatcacatttcttttagcctcgcaacttgtacttttcatcacttttcttgtaatttagcaatatcccaagaacaatcatcgaaatgtcccgtccacaagttactgttcactctttgactggtgaagctactgccaatgccttgccattgccagctgtcttctccgctcctatccgtccagacattgtccacactgttttcacctctgtgaacaagaacaagagacaagcttacgctgtttctgaaaaggctggtcaccaaacctccgctgaatcctggggtaccggtcgtgccgtcgctcgtattccaagagttggtggtggtggtaccggtagatccggtcaaggtgccttcggtaacatgtgtcgtggtggtcgtatgtttgctccaactaagacctggagaaagtggaacgttaaggttaaccacaacgaaaagcgttacgccactgcttctgctattgctgctactgctgttgcctctttggtcttggccagaggtcacagagtcgaaaagattccagaaatcccattggttgtctccactgacttggaatctattcaaaagaccaaggaagctgttgctgctttgaaggctgttggtgctcactccgacttgttgaaggtcttgaagtccaagaaattgagagccggtaagggtaagtacagaaacagaagatggactcaaagaagaggtccattagttgtctacgctgaagacaacggtatcgtcaaggccttgagaaacgttccaggtgttgaaactgccaacgttgcttctttgaacttgttgcaattggctccaggtgctcacttgggtagattcgttatctggaccgaagctgctttcaccaagttggaccaagtctggggttccgaaaccgttgcctcctccaaggtcggctacactttgccatcccatatcatctccacttctgatgtcaccagaattatcaactcttccgaaatccaatctgctatcagaccagctggccaagctactcaaaagcgtactcacgttttgaagaagaacccattgaagaacaagcaagtcttgttgagattgaacccttacgccaaggtctttgctgctgaaaagctaggttccaagaaggctgaaaagactggtaccaagccagctgctgttttcaccgaaactttgaaacacgattaaacttattagtacattaaaaatattcttttattttttatatacatacataagcctttaatacctttaaagcggtaacgactgcctcttgaacttaaaattattcttttttttggatatttgttcgttatgtttaatgtatatatgttgatgttcgatcagttttacgatatgctcttataggaacatttacagttttccccgcattgagtccagaccgaaggttacatacaagatttcttcagcgtttgttacttcaggaaggcaatggtaatcatacgtatcacattgagcaacctactgagggagaaaggagatttgtgcctggaactacttcgtgtagacaaaggaatatacccctttgatacttctcaaccaattggtagtatgcaggtgctgctcccccacgctagtaattaccccggttccgctcaattttatctttttgacgcggctacgaaactcggtttcgagcagtccgttaacttaaactacagtgaaaatcattggttaaacaacactccatgccagtatctgtatgtgtttttgcaacaagcacgactggagtaataaagagtcacgctagcaaaatttgtctctataagattaagattctgctttatagctttggaacctttcgtagctgtagcccgctacgtagaaatacataacaatagaataatctttcaaaaatgtcacaccatgttcctaatttatatggtacacctattcgcgaccctcacgaacgcaaacgcaattcagcgtcaatgggcgaagtaaatcagtcagtttcttcgaggaattgtgaaagaggaagtgaaaagggcacgaagcaaaggaagaaagcctctcacgcttgtgaccaatgtagaaggaaaagaatcaagtgcaggtttgataaacataccggcgtatgtcaagggtgcttagaagtcggtgaaaagtgtcaatttattagagttccattgaaacgtggtcctgcaaaaaaaaggggcagtgtagtatccattgaaaaattcagctcggataatgatcctcttcaataccgaccaagaacacattcatacccaatgaactcgggaaataactacttaccatcactcgccaggaattcctcttttccttccataagcagtctatttgttccctcgataactgctcaatcgcaacaatttgtaaaggtgccgtacgatgacatcaagcgtaggagctctctggcaatattaggcagcgattcatcgatatctaccgaatttgggggaaactatcgcttagatgaaaacttaaatgtcaggcaagaggggaaggatattgtagcgaaaggaatgataacgcccgtggaggaaatgggcgcatgttcatctaacgttcgtcgtcagggttcacaatctcttccaattcaagaacagcgcgctagcccgtacattaacccttttatctctgggagatccaggctaagcagcctttcctatacaagtgaggctacaacttcagaaggtaatacgcaaggtaaaaaccaatgcatgcttactcccaatagtgtacgttccattgaaaaggaacgattaaactcgttaactgcgggatttccgaacaaaaaattaggcacagatggtagaagtgacaaatgggacaaaaattcgacttggaagcctgtatatcgatcgtcgaatccttctcatcctagcactgaaaaaaatgtttccttgaatcaggaagccagtgctaaaccacttatgcttggaacctacagacagtttgatgcaacctcgttctacaaggttttaggcatctactataactttttccatattaattttcctgtaataccaattaacaaaagtaaatttactgacatgcttgatcctgaaaagccaaacgtgattgatgagatcagacaaattaacaatgaaattatccagtgttttaaaaccgcgctagaggtattggtattttgcaaaataaaacaaagaaggtcatcgaaatcaacaaaatcatggtctcgtgacagtttatgcgattttcaaaaaggtctgtattacattcagaatttcaacaaatgtatagccgactgcttccaaagtttaataactataaaacccgtattaaaacaaaattccagtgttattccttcaagaataaagttcatttacttttcgacaataatagtgttaaattttatcttaatattggccggtgaggaaagctcgcttttgctaggcccctctgttggggtttttaacgaatttcaagctcataagttatttctaccttttcaaaatacgtccccaatgctattattaaattcaaacgaggaaagtggtgacgagatactggattatgctgtgttgttcaaaaggttgtacatccttttaaacattctggatacgctacaaagctttcggctaggtcaaccaaaattaattaatctaaattttggtagcgccattgaaacatattttagcgataaaacaggtcataaccaagtcgtcgaaaaagctcccgtagctttggataacattctacgaaaccttaaacttggtgaatttataacatattttgtccttaacagaaaatcattgcaagtaaatgtacctcaccacttgctgttcacaaatcaaacggattacggagagttcgctgttgaaaaaggggaacatgataatatagctggcaaatttgagacccttttgaagaaaaaggaaattttaatcagaaaattactaaatattgaacagaaaaatgaccatattctagaaaattgctgcaattcggatgctgaaatgaaaaatatcggagagctagtctgctcaatgatcactctggtatcaggcatattagattcaattactaatatgaacgcagaaaactctgttgatttggattcaaagccccttccgaacgcctattttgctcaggacagtgaagaagaattaatgtcgccaacacaaagtattacgtcaaatcttgccagtgaagaaaatacacgttgcacaaccaaagacttgatgggaactgtttctattttcatgctgccaatggtggaagaatgctataatatcattagtttgataggacccatacctaccacattaataagtttatacatccgtaatggaaatatggccaagggaataaatgacagaattatgacgttgtcaactgcgctgaacgaattggtgcaaataaccgcactatttaataccctagaaccttttaggaagaatgcacatgaccgtgctaagcgttactatgtaagtgctacaagtagtaccggatgctacgaatcggtaatgaagagcatgtattccggaaaatgtgcagctagtaacgcctcaaacgttgcgccatcggaggaagaaaacaaaaagatattgaaaaagtttgccgacataggttggaaattgatggatgattcagaattgggttgttgctgttgcttctttaactaatattcatgataacaaggtgaaaaatagcatcctaatgaaggatagataagtagattttttcttttaaaaactatagtacaaggacatgcaaagtcatatatctaaactaattttggtacacgaccaacaaaaaagggtaacaaagtacacatattcgcgtcaataatatgaacaagtttgtttatttgcttttcaaatttttttctttctccagcaaacaaaagtcttaatgcattaaataagaaccttcgttttttctgcttcttgaattaccgtcgatgccattcgattcgaacttgtaagaaattttgatatttagatctctgttattcttctcgtttggagagcaaaccaattcaccttcaatggtgtcaccagtttcagcatctagatcatcagggaaataaaatattgtttgcttccagtgagtgtatggagcatgaggaccagtggagaactcaacaggtctcttaccctttggtgcagggaaaacaatgtcgaaccaggtgactataccattaatcatatcttgtctcttggccgtcaatttaaagttactcttaaacgctagatctgatatttttactgtatttaaatcaaattcgatcaatttgtctgaggtggtgttgacattgtttctttccacggtgtcgacgatgggctcgtgtaagaccaacggaacaaatggcgaataatcaaacccgtaaacgtcttgccagtagttcaacttctcgtctttatactgagagtcttccaaaccggccaaatgaatggagcacttgtcgggaaagatcagaccgccttctaccaaatagtggtctctagcgtaaagaacggtgtccatcatggactcgtatagtagaaagtaacccatccattcagaaattatgatgtcaactttaggaaagggtaaatgaacgtcctccaacttgcctcttagcaaggtgatcttgtcgctgaatccgttcaactctaccaattccttcgccatctcaataatgcttgacatatcaacaccgataacatgcttcgcaccgtgtttagcggcaaacatggataaaataccggtaccgcaaccgacgtctaaaacaatcttgtccttaaaaagatccttattttggataattgcgtttctgtaagataaggtacgaacagtatcttgaagcatctcttcgtgaataccatagtgatcgtacgaattgaagtagtgctgttcgctttcacttagcttggttttttctgtagcagaatctttcacggctgtcttgctcattattttctttggatgaatttgtcggttctaactcttttttggaaacggcaaggtgagcagtaggcagctcatctcttcaactatttttataacatataatttccctttgtgaaaaaattttcccgccatttccaaatttcggaattcctttttcttttttttcatctcggtatattctgacatattaccctataggcggtataaaaagattcattatacagtataaaatagaaaatgagagaattatatggtgttaaatagatcctacattgaatttttcattaacagtccctcatggggctagtctaacgactttccatggatcgttttctgtttttcttctgtaaacgaatctatcatgcaatctcgagggtctaccttgccagaactcaatttccagtggaacgattctcaagccaccccaataatctggacatgggatgtcttcagcatccttgaaacgttcggtgtttttttgggtcaactcgtctagttcttctctgttcttgataacatccgattggcgggaagcccatgcaccgatcttggatccacgaggtctcgtcttaaagtatctttcagaagtttctctgttaacatgctctgtgataccttcaactctcacctgcctttgcagatccttccaaaagaatacgattgccgcattcgggttggtagcaatatcatgagcctttctagaggttccccagttagaataaatagtaaaacctctatggtcgagctccttaaaaagaagaatcctggacgacaccctcccactaggtagttccgcggatgaaaaagtaattgcttctggcaacgtttcccttgggtcttccttggcttcgttgaaccatttggtgaaaagatcgattgggtcgtcagtaagttgtttttcattcaaagtaaatttatcatattgatacgtctcaggagcaaatatgattggcttttgggtctcctcagcttgtttagtcattttcagtgcagatccgtgaagtgtactactggtctaggtagagtatctttaaaatatctaatcatgcaaattagtcatttcttctttcttataagttgcggccccttctagtatttacaatttacccggcgctggttctggtggcatctataagagctctatctggctgctaagcagacttgctgttacttgtatgtgctgtttatcaagattggggcattacgcatgtgtatgtgtgaactacagtagtgttatgaaatacagcctgaaagacgaaaacttcacaacggaacttaagcggttcaataaacatctatctgccagcttagagagactacccgtggtagagaaagacacgggcagccaaaaatactgggtgttgtatatttacttgtgttagtttataaataaattttatatcactatatgtgtggtgaaaaggaagagcaatcctgctaaagcttttatatctaaacgccaaaaaaataaaaaaaaaaggaaatgggagaaaagttttcagcgcgcgaactcgcgaaaaaacttcctctttagcaatggtgacatatagatctcaaggttctcaattaaaagaccttctttgtagcttttagtgtgatttttctggtttgagaataaaactagagaggaagataggtaccctatgaaaatgtcaatggctgttgcgtttgcttaatcgtatttttttttttttcagtccgtgttttttgtacattctacgtttgagttttccatcatgcaggcctcagaaatttggtaggcactcgatggtgaagagatagtgtcggatttcggattgatctttcagttgatagcctgctgctcttttcttttccaaagaatttcgagtatgctggtgtcagtgtagatgcttgtgtgtgcgcaatttgtggttttttattgtgtttctacttatagatggctaaaatctgagtttagaaaatgcaaaccgtaaattcttaaacactgctattgcatttagttgctaaagcagtgtttttgaacttattcctgttattccttcttcgtaccgatcctcttctcgacctaaccttttaattaccatgggaagcctaccatcaccacacccacacacaaatgttacagctaattgtttattagcaaagtttgcacgagttcgctgtttatttttttctcgttttcttatacctagtattttttctgacactgtttaaggtgacagaaaaaaaggagtttaagttagatttgcaaacagacggtgctaagcgctgtcactttatgtctatcttatcgttaactctggaaaaagaaaaaggaaaaagaacgtcagggaacatgagtatatatagaaatggtttattctagttttttccgttttttcagtagatttttgcctttaaaagaataaatcccactacaaaaaggtaaaataaaaaatctattcactgaacttactgatgaaatttccaaatgtgccccgtacatcgaacgatgtgacagagaaaaatacgagtaggtaaataagccaaaaggcaagggtgtcctttcttaagcatcggttaggtttgcgggcgatcagtaactgaacaatgacacaagatcaagaacgtaatttgagatttttcaagatggtttttttaggtatctattaaaactactttgatgatcaatacggtatttttgtcgcattattttccaagcggaaggaaccgtgtgttcattttatgaatcttggtgttgtattcacagctacttctcctaatgccttcgatgcatttagataatttttggaaacattttttttcttgatgtatattttttgtattgtagaaatcgcgcgtactgtacttgtatatcgctttataagcgcttttaattgattgttcatgacgaggataggcggataggcggaggtatgcctcttaatatttataataaagcccaccaaatggcttcttctttttagaatatacaatatacaaataaaaataaaaaaatagaagaacatcctagtaattgtcttgaaaataatcaagatattgattgggattttttatttagggaaaccaaataattgcatatgcttgttacatcatcatcagtcatataaagtatgttgtccgtactaatggtggtatttaccttccccgagtgttactgataggaccaacaaacttaccgttagcattatgtatcctatgacttcccatctcacaattgtggtttgcgtaggttcgcaaacccactcagctaaccccataaagataatagctcccaggttgcacgtcgtcaaatactcagcaggggccttgcgattcaactctaatatcgaaatcaagctcggcaaggaaccaaagataatcgagcctagtagagagaaccaaaagctcttgtcattatagaacaacgaaatggattccacagactcacgggagggaaatttaggaataaatggcaaaagtattaccatgccaataataccgattagggccatgtgggtgctctgcttaaccaagactacagcagaattttcgttcttggaaatgttactgcaaaaccaacggttccataacacggcaaaaggacccataatcaaagcaccaaggccgcaaatcagagcacctttcaacctatcaaacaagaatgggtcagaaagttcacccgtgttagggttgacggacagctttccggcaagcatgtcacaggtagccttcgtgtatgagatgatcaaaattccaatgaccgcgttcatcatgatgaggaaattacggaaaacgtagttcttcctggagattccacaaacaccatatagtaaagtgacaatttcgaaaatggcagtattttgcatcaaagcaacatcaaatgccggtgacaatgacaaagccatgttataagtcaaatcagcgacaatcattatgagagccagcactgttagcttagccacatatttgaaggtagccacggatatgattttttgcttctgctgttgggctggaatccgtggttgaggatcatccaacacgtgcgagaacgtatcgacatcttcgtttgtcacagacccgctgttgttgttgtcaaactgagaattcctgttcgagtctgagtcagagacaaacatcggtctcatcttctcccaaagtcgagatgcaggcaccaagagcagccacgaagcaaaatacataaaggtcagatagaaggttaatgaacttgagtttccgttgtcgccgttagtttcaggcgttgcaattgtaccattgggccccacggagatttcctttttagattgtatgttagacaaacattttgtttgaatcacgtagcctattacacttgaaaaccaaagtagtgtggtagacatgacgctgtatctttgtttgttatcgtgctaactcaccagctcaagagcggatctgttctggaagaaaatggcctacaaacatttctttcacttgatcttcccacgttcacatagcctcctttagagtgagagagctttttttttcttgcgatacaccttcgccgggtgatagccgatattacaagaacgggttatagcgttataagtatatatgtatatacaaggaagaaagtagcatatatttacaatcttatttgaataagaaggagtaccatgcctccttctgcttggcgcgctgctctgcaggcacataactcttaacgtgttccacgatcttgtccacgcccgttttttcatcataatttctacccaaagcatcaacaaactgtccttcagggtccatgagataaaagaagatggaatggtctaccaaataatcttggcccggtttgacgtttggaggcgtagaaaagtatactctgtacttcttgcatgcgttcttcacctcatcgaacgtccccgtcaaacccaggatggagggatgaaagtcgctcaaatactctttcaatacagcaggggagtctcttgctggatcacaagttataaataatggctgcagagtaataccatactttgaagagagtgtattaagccatagacctagcttatccagttcatcaggacagatgtcaggacagttactaaacccaaagtatattatagaaaacttaccgagaaggtttttctccgtaaactcattgccatacatatcctccagatggaagggtcccccaagtgaaggtttaccgtatcctctgtttgcttcagcctccttctgtgtttccaatctgcgtttctccctgttgaagaaataagaaagtgccccaccgactgctaggaatagagcaatggcctttcccgtggaaaactcgatcgagccttctcgcactttgccgttatccttaatgggagtaccgcccacaggtactctgcttaatggtttcttgccatttgactgccataagcgcgttacagtaaagaatcccctttgagtgagcaatttagcgccattgccacttaatcttgcggctggcaattggaccaatcttagattggcacttcttgacaacttcagcatcttttctacgtttgctgttttttctgtttcccttgccttatacgaacatacgtttctaatgccgattataaacacaatagacacaattatactattttctcacttttctcttcgggagatcgctattgattattattcccgtttatttccttcaatttagggtctgaaaagaagatagtagggttagttttttggggtttaaaaccctagtataaacccctatactatttgtttatatatttcctatttgagtatgatagcatcgatattgaaatttacagaacttcaatttagtttcaattgggaattcgaggactctcccttgggatggccccagtctatttaactatcttccataatattactgttgatttcgtgactcagaagagaaaacagaggaagttacatatagacccaaataaaaaccaaagaaccacatatagaaatgacgagaaacccgtttatggtggaaccttcgaatggctctcctaatagacgtggtgcttcaaacctctccaaattttacgcaaacgctaacagcaactctcggtgggctaatcccagtgaggagagtttggaggatagctatgaccaatctaacgttttccaaggccttccggcatctccttcgagagctgcactaagatactccccagaccgtcgccatagaactcaattttaccgcgatagtgcccataactctccagttgctccgaacaggtatgctgctaatctacaagagtctcccaaaagagcaggcgaggctgtcatacatctaagtgaggggagtaacctttacccccgcgataatgcagatctaccggtagacccctaccatctatcaccccagcaacagcccagtaacaatctgtttggaagtggcagattgtattctcaaagctcgaaatacacgatgtctactacttccacaacggctccctctctggcagaagcagacgatgaaaaggaaaaatacctcacttcgactacttcctatgatgatcagtctacaattttctctgcagacactttcaatgaaacaaaatttgaactgaaccatccaacaagacagcagtatgtaagacgtgccaattctgagagtaagagaagaatggtctcagacttgcctcccccaagcaagaagaaggcactattgaaactagacaacccgataccaaaaggtctgttggatactttgcctcgtaggaactcccctgagtttacggaaatgagatatacagcctgcactgtggaacctgacgattttttgagagaaggttacactttgagattcgcagagatgaacagagaatgtcaaattgccatttgtattaccatgtacaatgaagataaatattcattggcaagaaccatccactccattatgaagaatgttgctcatctttgtaagcgtgaaaaatctcatgtttggggccccaatggctggaagaaagtctctgtaattctgattagtgacggtagagcaaaagtcaaccaagggtctctcgactatttagctgctttgggtgtttatcaagaagatatggccaaggcgtctgtgaatggtgatccggtaaaagcgcacatttttgaattgacaactcaggtctctatcaacgccgatctggattatgtttcaaaggacattgttcctgtgcaattggttttttgtctaaaagaagaaaataagaaaaagatcaattcccatcgttggctattcaacgcgttttgtcccgttttgcaacctactgtagttactttggttgatgtcggtacacgtttaaacaatacagcaatttacaggttatggaaggtttttgatatggattcaaatgtggctggtgcggctggtcagattaagactatgaaggggaagtggggactgaaacttttcaatccattagttgcatcgcaaaattttgaatataagatctcgaatattttagataaaccattagaaagtgtttttggttatatctctgttcttcctggtgccctgtccgcatataggtatagagccttaaaaaatcatgaagatggcactggccctctcagatcgtatttccttggtgaaactcaagaaggcagagaccatgatgttttcactgcaaatatgtacttggctgaagatagaattctttgttgggaattggtcgccaagcgagatgcaaaatgggttctaaaatatgttaaggaagccactggtgaaacggatgttcccgaagacgtttctgaatttatttctcaaagaagacgttggttaaatggtgcaatgtttgccgcaatttatgctcaattgcatttctaccaaatttggaaaactaaacattctgttgtacgcaagttctttcttcatgttgaattcctttatcaatttattcagatgcttttttcctggttttctattgcaaatttcgttcttaccttttattatttagcaggatcaatgaatttagttattaaacatggtgaggccttattcattttttttaaatacctgatcttttgtgacttggcaagtttattcattatttccatgggtaatagaccccagggcgcgaaacatttattcattacctccatggttatactgtctatatgtgccacatattctctaatttgtgggtttgtttttgctttcaagtcgttagcttctggaacggaatcccacaaaatatttgtcgacatcgttatctcattgctctccacctatggcctatactttttctcatcactgatgtacctagatccttggcacatgtttacatcatccatacaatactttttgacacttcccgcctttacgtgtactttacagatttttgccttctgtaatacacacgacgtttcctggggtactaaaggttccacacaggagtccaagcaattgtccaaggccattgtcgttcaaggtccagatgggaaacagattgtggaaacagattggcctcaggaagttgataagaagtttttggaaataaaaagtcgtttgaaagaaccagaatttgaagaatcaagcggcaatgaaaaacaatccaagaatgattattatagagatataagaaccagaattgtgatgatttggatgctatcaaatctaatactgatcatgtctataattcaagtctttacaccacaagatactgacaatggttatttgatattcattttatggtctgtggccgctttagctgcctttagggtggttggttccatggcctttttgttcatgaaatacttgcgtataatagtgagttacagaaataaagttgaaggtagcggctcatgggaagtctctaaattagacttaccaaatgttttccacaaaaagggctaatgccagtatttttcagctaatttctcgtcattccctcttttttctcattctgttttagaatgtacaggttatgacaaccattaccttctaggatattttgacatttctctcttagactttttatatataatatacatgtttcaataccaaatataatgtagcataacataatctatctttttactcatagacctttactttcctctctaaaagccgtgtcgcagtaactggtgacgctaaagttctccggcgtttttttatgtatgagctgggcatcaagaggcttttgagattttccaagtagtaactcatctttctgagtgtgctatcaaatacatactaaggagaataaactcttgttattacgtattcttcatccttatgggtagagagcgcactgttttagtacattttctagacgtcgaaacgtagagcaattgtcgataaaacaaaaaaaaagtaagaagatatatgaataggacgtgtcgctagaactagtaagtatatgatggagatataataagtgaattattcgatatttaatgaacgttctcatttatttggaagaaatgtttatcacgtgatggagaaccaatgagcggcgagtaactacgcgaggaacccggaccgcaataacgattaaagaaggcccggaagggagatgcttaaatgattatcactcagttaaaaaagacaaataagaaactattgagactgaaccgttttggttaatttcaggtggaaacaattgaagacgagcagtaaacattattttatttagtagtcatgttgtcaagaattgtatcaaacaatgcaacacgctccgtaatgtgccaccaagcgcaagtgggtattctttataagactaacccagtgagaacttatgctactttgaaagaagtggaaatgcgtttgaaatctatcaaaaatattgagaagatcacaaaaactatgaagattgttgcatctacaagattgagtaaagctgaaaaggctaaaatttccgcaaagaagatggatgaagcagagcagttgttttacaagaacgccgaaaccaaaaatttggatgttgaggctactgaaacaggtgctcctaaagagttgattgttgctatcacctctgataaggggttgtgtggttctatccactctcaattggctaaagctgtgagaagacatttgaatgatcaaccaaacgccgatatagtcactattggtgataaaattaaaatgcagctattgagaacccatcctaacaacattaaattgtctattaatggaattggtaaagatgccccaactttccaagaatctgctttgattgccgataagttattgagtgtcatgaaggccggcacttacccaaagatttccattttctacaatgacccagtgtcttccctatcttttgaaccatctgaaaaaccgatctttaacgccaagaccattgaacaatccccatcattcggcaaatttgagatcgacacggacgcaaacgttccaagagatttgtttgaatatactttggctaaccaaatgttgacagcaatggctcaaggttatgctgctgaaatttccgccagaagaaacgctatggataacgcttccaagaatgccggtgatatgatcaatcgttactctatcttgtacaacagaacaagacaagctgtcattactaatgaactggttgatattattactggtgcttcctctttgggatgataaaaaaatcaccctgcattgcctctttatttgacgttgtttttgtagaacatgaaacgaattttgacttgatgagacgaagtatatatccaaagaataccttaaatagaaaaggaaagataataaatactaaacactactatatattcaggtaaaatacaaaaattataacatttttaaaactttttttttttgaaagtccttctcgctttaggattttttcccattaagattatgatggtttcatgtatgtgtcagttaaaaaaaatatggctaagtagcaatgaaacgaaccaagaaaatgaaaacaatatatagtgctgttgaaataacaaagacattggtatatatttgtaaaatgtctgttaaatgttttttatctcaggttcttgcttgtctttggtagaagaaattatagtaaacaaacaaacaaacaaacaaaaaaaaaaaaaaaaaaatggtcgcaatctcaatgatttggttttttaccaagcgtatgcccagaatatttgcattagcttttaatttaatttcaatatttcttttgatttttcttctcatcggctgttacaacccgtcaaatcagtcaacatttctagtgaagtataaatttgatgacaactcacctttttatacgatcatagagaaatcatatgaaaaatcaaatacaactctgggcttggaggaagtcattataagatccggttacatgggtgtttgtattgataacattccctcccaatatagctcttacaataatatgactacattctccaattcaatttgctatgcaagaaagaatttaagctcggttcccttatacagagacttggaaattcaactctcaaatattgcatcttccagctccaaaacccaatcaagcgttgtcttgaacattttgaagttagcccaattaacttcggttaatgttatacatccatatgtcttgatggcaactgtaatcctaacaatcctaatgtttctatttattctgtatgtaactgtccctaagttaccattcaaactagcggttaataaatttctactgttgctaagttcaactatagttttgacatggggtattggtgcgatgtggactcatgtagggataaatgcaagttacagattggttccatcatcaagtatgaatataatcactgtcaagaagggcaagaaggcagcagtaatggcttggtttagctttgcattcctccttttagacagtgtggttttatggttaatatttttaagggataggaaaagcttgaaagatgaaattgataatgttccatgtgcccaaaataggtacaataactactcttcggattcatctacattgcattccaaagtttagttttatcctcaaataaacatataagttttgagcggatatttcagaatgtcaatttttaaaagtaaaaggagaaaaaatttatataattcacgattaacattatataatgtgatgaactacttaaaaaatttaacgttcgataattaagtaacaacagagaaaatatgagcttacctaaactctaatcattaccgtctgttttatttactgtcaccttgatgagcgactaaaaagatagaacgcgggtttttcgcgcaatgtaacaaagctccagaaattttttataaatactaatgttatagcaaaaaaaataaggaccttaaagtcgtaaactaaattgaaaagcccaaatcattcaaattctatatcgttgaacttttaataggctgcgaataccgactatgtctcccatacaggttgttgtctttgccttgtcaaggattttcctgctattattcagacttatcaagctaattataacccctatccagaaatcactgggttatctatttggtaattattttgatgaattagaccgtaaatatagatacaaggaggattggtatattattccttactttttgaaaagcgtgttttgttatatcattgatgtgagaagacataggtttcaaaactggtacttatttattaaacaggtccaacaaaatggtgaccatttagcgattagttacacccgtcccatggccgaaaagggagaatttcaactcgaaacctttacgtatattgaaacttataacatagtgttgagattgtctcatattttgcattttgattataacgttcaggccggtgactacgtggcaatcgattgtactaataaacctcttttcgtatttttatggctttctttgtggaacattggggctattccagcttttttaaactataatactaaaggcactccgctggttcactccctaaagatttccaatattacgcaggtatttattgaccctgatgccagtaatccgatcagagaatcggaagaagaaatcaaaaacgcacttcctgatgttaaattaaactatcttgaagaacaagacttaatgcatgaacttttaaattcgcaatcaccggaattcttacaacaagacaacgttaggacaccactaggcttgaccgattttaaaccctctatgttaatttatacatctggaaccactggtttgcctaaatccgctattatgtcttggagaaaatcctccgtaggttgtcaagtttttggtcatgttttacatatgactaatgaaagcactgtgttcacagccatgccattgttccattcaactgctgccttattaggtgcgtgcgccattctatctcacggtggttgccttgcgttatcgcataaattttctgccagtacattttggaagcaagtttatttaacaggagccacgcacatccaatatgtcggagaagtctgtagatacctgttacatacgccaatttctaagtatgaaaagatgcataaggtgaaggttgcttatggtaacgggctgagacctgacatctggcaggacttcaggaagaggttcaacatagaagttattggtgaattctatgccgcaactgaagctccttttgctacaactaccttccagaaaggtgactttggaattggcgcatgtaggaactatggtactataattcaatggtttttgtcattccaacaaacattggtaaggatggacccaaatgacgattccgttatatatagaaattccaagggtttctgcgaagtggcccctgttggcgaaccaggagaaatgttaatgagaatctttttccctaaaaaaccagaaacatcttttcaaggttatcttggtaatgccaaggaaacaaagtccaaagttgtgagggatgtcttcagacgtggcgatgcttggtatagatgtggagatttattaaaagcggacgaatatggattatggtatttccttgatagaatgggtgatactttcagatggaaatctgaaaatgtttccactactgaagtagaagatcagttgacggccagtaacaaagaacaatatgcacaagttctagttgttggtattaaagtacctaaatatgaaggtagagctggttttgcagttattaaactaactgacaactctcttgacatcactgcaaagaccaaattattaaatgattccttgagccggttaaatctaccgtcttatgctatgcccctatttgttaaatttgttgatgaaattaaaatgacagataacctcataaaattttgaagaaggtttatagagagcaaaaattaccaaagggtttggatggaaatgacactattttttggctcaagaattacaagcgctatgaagtcttgaccgctgctgattgggaagccatcgatgcacaaacaattaaattatgatttgatgttcctgaattaggataaagtatttttccttgcacgagagtacgtatgtaaacgtaatattgataaagaatcaaaaaaagttttatatctatctatatatgtacctaataacatatggaaaggattatttaaattcaaaaaataaaacaataaagtttataaactaaccaaattattgttagagttggtaatattagcacttcagttaactcaatacgattgatcttgaaactatcggtaactgaatggtttgtttcaggatcacttacgaatgatccagtggaatagtacctttccattagagcatccttctcactccaaattttatacagccattctgaaaattcattctcgtcctctaatggaatatctttaacatcaaatgctctgatgtgaatatcgactaacttcgggtattttccttctaaaaatatgctcttcagcccatatataagctcaccatattcctcctgttttacaccggagtagccgatcgtaatatcataaagactttcaatacttggcttcaacttttgtaacgagtatcttaggcctgtagaatgaggcagtagcacattcttgaatggctttttgcctattttggcagcatatttagcacttttttgcctagtatcagcactgagatttgtaccttcagggaataggataagattgtatggccaatggatttgttttggatcaataacctccggattccatatgctctctccttcctcagttatgcgctcaggtgactttccagcaagtgagccggcgccccttgcattcgaatcaaggccagcaaggctgttgcttagggttattttgtcttgtgcccactttctactcataaaaatgaaattatagtttctcataccgaaaccgaggataggaatggaagccaacgatttttttaaaataatgaagacattagcccctaagttcgatgtgtaagccaaccaccataaaaatatccaatccgtgtatatttggtgattgcaaatggccaccgaattggactttagatgagaaagaatccttttcttcttcaagtctaaaaaaaaagtacctttaggaacactggaattttcagtggtaattctcactgcagatggtgcgacaacatgcaaaatggatgataccaagacaataaataatcttttggttttattgagaccaatttgtttccttatatcatttctacagtaaagagtcttataggtgagttggagaaacaaaagaataaggcatccctggaagaaaatcaataaggaaatacctgggacgacgacttttcgaactttatgagctattttttgatgcagcatcagcttattgacctcgctagcaatctcaataccagtggacctgatatatcctttttttttgttggctagtgttcattaatgatctttcgcgtttatatttctttttctgatgagtttttcgcctcttgagatgttgttgaacattatttaataatacttttagcacaataacgatttaccataaactaaagtaaactatgtatgtgccaccctatgaaaagtctacaatgaaaatatttacgcttccgtcttattaaccgatatgattaatcaattttgtcgtacaatttttgtaaatcgtagttctctctccagtaatcaccgtgctttttcagtattataagtacactgctagcacccaagacgataaaggccagcattgtgaaagcccacccagttcccataccgtttaacatgggtgtggtgacaaagactgcggttgcagccaagatttgccttattaaattattcaaagcaacaccggtggcaccctttcccggcaatgaatcgactaaataggaaagggtagcaccaattgtcatcatagctgcatatccaaagagggctgttccaattagtggcgttacccagtggcattttttatctaggcaccagccaaatatcaatagcgcaatggggaaagatattacagatgtaacaacattccacgatatacgagcttcaggagcaagaattccatatttctctttgtatctttttaaaagcatgtccacccaacgtccaccgtaaattgaggcgaaaaagtatgttacagaattcggaatatacagtagaccaatgtataatggtttaaagttgtaaggaggccttgaatatttatattcaactgtcatattaacaaagtatactgtggaaaaggaaattgcggaaaatgttattgcaagtgccacgggtggatattctaggaagtgcaatgattttaaaggcttgataaaataaacaaaaaaggtgtcccagaccttcctcaccgctgatacctgtttaggagcgatttcacctccattactggatagcacttttttgacttgctcttccaggttggtttgtaattttctcagactattttctcgaatcgatctcgctaactttggatctgttgatcttattctcgtaacttgtgctgttgttgcatcgataccgctatcatctagctgatattcatacagacttctactcgcctctgtataaatccgttgcaattgggtttctccagctcgaccatcataagtattggggctagagtgactttctaaatctagcgagtcttgatcccttacctctccaacgtagttatgcttctcagtagataatgtggcaacttggttttcaattcgatctgtctcatcttctcccctctgataatcttcttgtatctctccacgttcgttattgtctacttgaatacgtctttcagccaaaatttgagcgatagcgcctttagaatcttgttttcttaatgtttcaggtagtaacaccgtcaaaagaatgacattacatccggataaaataaccataaaccattgagtggatctccagggccagcgattcactaacaaagatccaaaaattggagatagtagcggcgccagtagtggacccaaatagtaataactcaaatttttacctctatcttcgctaatatataaatcagccactgttccagcacctacactttgaacactggcagaagcagccccacagagcattctcaaggcaataaatgagttgatatcaggagctagagcagacccgatattaaatgcaaacaataatgcaaatgaagttatgtaagtagttcttctgccctctagctcggatagagaagaccaccacaatgggaaaacaccaagacttaaaaggtacacaccaattgaaacgtttaccataatcactgatgttttaaattctgttgtgattgagttgatcgctggaaaaatgatagatgtgcccatggggcccatcatggaggaaaacgcaatcaagaagacaatcatctttttcatcatcggtggataatctctggcatccttgaactccggtataatggcgagttgaggcaatagtcccctacgttgattctttggaacaacgtattcctcactcttcaacctacttagctggttgtctctgtgttcacgactatttgatgccgtactttccagattggtcttttcgtaactataatcgttgtgctcgctgtgcggcgtgccgctgctttcatcgcagtgcatcataacatgattgttcggtagtgaattgtcagagcaattactcctcaaagaccctacattcgattgtgaaccttgggcttgcatgtttatcgctttctgacttcggtcctagcatagacgttaacaagttagaaagatgtgaatacatatgccttcaaccctgttttcttttaaggatacaaggacacagctattacaacaaattttgttggtttctatcttatctaatcgataatcttttaatattttaatctaatcgcagttatccaaaactggaatgagatggttcaaatccccaaaggtagatggagttactgctgaggcgtggaaaaacccgagtttttccgaagccgcatatgagaaattgagcaggaataatagatatttacgaagaggtaaaagtgataaaaggcagcgccgtggcaatatctatttacaatgactcattctgactatttaaaagtatgtaagggctttatctaggctttgtgccgttcaggcttttgtatacacatgtgataattgtattacagcttgtaagtaattcaatgaacgtttctacaccggctaaacaagaatccattttgctccatggctccaagtttccatcctttactgtgttcaccggttctgaatttggagaaaacttggccattggaaacgatttttcgtttatagcgcctgctatcaggctattgatctcataatagttgtacccatatgcattcttaaacgccacttctgatgggagaataactgctgataaaacagcattgatgcctaccttagtcatgaaattgggttcatttgctttcagttcattcaaacctggaattgccttcagtagggagatgccgtaacctgggatgaaacctttggccagcccatgacataggacgttatttaagcaattatctattgcatttcttcttctgtcgatttcgatttcgttatgtccaccaatgcttaaagtgaccgtattttggaggaaggatttcggaactttatttggaatcgcttcagcatcaatggagttatataagaatgcctcccctgtggtcgcttttatggattcgatactgccgtaatatttatccgcacacattttgcttggcactaaaggactatattctggtgagtagatgctgtcatatccgcaaggcaaccgtaagaactttataaaatcaagattctcctgtggcgctaagtcattgttcgcctttttagagtacttcaaaaccactattcggctttcattattttctctcttgtttctgttattgttaattgtaacggatgttaatgcatcacctgtgcaatctccgttaacgattaagagaacagattttctcaactttcttgcatacgttatcgtgggtagaattttattagcgtctcgtaacgtcccatcatacataagaactagcatatctttatcaatggaaactaatttcttagtaggcaactccagggaccttaaataggcttcattactatctaaaataccagctggatatttccaacccttggatacatcaacctcatcgtaagttttgttgccgtttatgacccgcacaatgtcatccgaaaacaattcataattaatggctttcaaaacccttttgatgctttggctgtctgaggaggacatagtcaattgctcgaccagagcatcaacatcgttttgacttttcactataatcttgttcttcgcaagaaaatctctgatatatcgtaatccggccttgatcccattggtcacttctttttcgggatacttgaaatagtgctccagtaaagagcatgtcaaagatgttgaagttgctgttaagttgtcctgaatgcaatccatgaataattgtagaccaaccctccccagctttcgaggcctgtttgattgaagtcgtgtgttggtagcttcatctacttgtagggaatctagtaactcacgcattacattgtgaagtctcatggtatcatgagaactaacgacctgtggcttggatttatacttaggttcatatatcaatgttttattgtaggaggatgaagttattattttttccaacagcttaataccagagagcgtatctctgagaacctgaaggttttttgttctatagattggggtgtgtaacgtttttaccgaacatttcgtttgatgatttcccaatttcctcaaacaattcctcagcatactcgttaaagcataagagagttttatgtttacagtagtgtgggagaaaataacgccaggttaaagctcgtaaaaggtaaactatcgcactatcgaaacttttgtttcacagggaatggaagaaagggcctttattttttacatttttttaagccataacggattttagttaccgagattttcaatcctataagaattacctaaactattaaaagcggacccatctaaaacataacgttcggcaagtagatgtattgttccaaaaaggcaatacatccatacaacggtgccaccgatctgtaatgaatgctccgtaatgtttgggggattcattaaatttactgctggaaccgagagagaaacacgacagagcaattcatataaatgaataaatgaaaactcggtcgtattgcccttaaacgtttataggaccaggttggctacttcctcatctcaattttgtgataggggaggtctgcgtaaggaatcaattcggataccttggtagtacttttaggggcacattttttatttctacttcttgtattattaggtatcactgagatctatctctaatgatgccttcactcccacagatagcggaagacattaatgcacttcaaatcaaaacttcttcaactaaagctactcttttcgaacgcagaagatataatttcattcctagagactttctacgaacctaaagtagcaaatttaaaaaaataaagagtttgatccaaccgaggttcgaactcgggatcttcgccgtgtaaaggcgacgtcttgaaccactggaccattggacccggaactcgatactatgtcatttttggatatcggttagttgtatacattggatatctcatctaaaagcattacgcatgccctataactggtaaattcaatgaatgttttgtaagttgaggggatgctaattccctacgaagtatttctatattatgtgcaactacatcaagaagataatattaaagttgttggaataagaatctgttggaatggaaatcaactatcgtccatcaactatagttatactactggtattatcatatacgatgttagatgatgacataagctatgaaaaaactgccattgaagttaaaggaagctgaaatgcaaagattgataatgtaatatgataatgaaacatttaaaacggaatgaggaataatcgtaatattattatgtagaagtatcgattccattcgaggattcctatatcctcgaggagaacttctagtatattctgcatacataatattatagccttaatcaataaaaaccccaagaattacctcaaaattcaccaatatctcaaaatcaaccttcatctgtctaccagtagtcatattattatatgttatcatatacagtgtaaaaaagatgatataaagattgaaaaacagtcatcagatgtttgggaagctgaaataaaatatagtaggacaatgggtgacaatatataaaatggagaaagaaatagtagccttattacgtaaaagtatcaatctcttttgtaaatttttgtatcctggggaagaacctttatcatattctctattcctaatgttataaccttaacaacaacgaaatcccaaaaattatgacaaaatccaccaatatatcaaaattcacataaagaaagccgtattctatataacattgcagaacatttttctaacacattaccaatcgtcaaagttctgcctttactaaatcaggtgctgaattttgaatcatatataaatagccaagtagtttgtgcggtcgattccaacgccgcttataatcctattccagcaatattaacaatgtagtcttaaactgatatggtaacgacagatagaagatagctgacccatattcaaccaaatatcttgtctagaaaggcgcatttgataggcaaaaaattgcacaggcgtattatctttgtatgctaatgcttttttatgttattcactgaatactaactatcagtagttgattccctcttagctacaaatgcataactatatgtataatcacgtagataatgtattgatgtaaagtgaaaacaattttacagagtattggcagttaagtgttgttttttcgctcaaaaaacatcctcatcaagcgatataatttgtgccccttgactacttatacctttcagttgcctaccaatgtttctttccgtagctctcatactaagtatgatatcagatttatcattaacggaatcttcgcattcaacagccgcaaaatccaaaggatattcttcagaatagtacttgcttagttgctctcctctcagtctataatttctgcttcatttctctgccttttatactctgtatattgaaaataatgtaaaaattgggctacacctactgtgtcacacttcgaagctctctgagactcctcatcatgctgtgaattcatctttgtctttagaattgacctcatttcagtagtcgaataaccactttgagtctcatctttgtttaactttttagattttttgtagattaaaagacgtgagttttcatcaaacctaacacttgaggtactccgatcctttatacaaagatctgtatccatttctgaaatgttttcgctgtcagataactctgcatcttcttcgttatcaacatatggattgaaagcatcatagaatcttttatttctaaaattcacgcatcttttctttttttgatgacttttgatcaaatgcgttaagttatcttggcttaaatcagctttaccaacttttgaaagaatttgtgatatattggtcctattagtaaggccgcgaaatgtggggatagtataaattttactacttccacttgagcttgtatcagataaatcggaaagttcctcagattcaactggctcgaatgtggtctctacatcatccgaatagctactgctcgcatcatctatgtctttatccaatgtatcatcttttaaggccgagctcacttcaattggtttttccattgcgtccaccgtgctagtattagagtctggtatgaccacatttccctctttctcagtggtaacatcgtttattgaatcctcatccatatttctgtattcgttatcactttcataatcggaggcactggaaccaattttgttagagggaaaatctactttttcaattaaaaacgaatccgtggagcttaatgcttcaattctttcttgaacttctttggtaatgtaaatggatggtgtactttccatcgaatgatccgattcaggttcatctgagtattgttttaagcatagcctcttttcagatgttgtatcactggaatcattgcgaatgcttcgttttgtgccacgtgtcgaatctgacctatcaagcgattcatttgattcaattggagtaaaagttgcaggcgctaagctttgcaaattctcttcaaaatgtttcaaatcttcatattttaaattattaaaaggaataaatttctcacttaggttccaacaggattcattgtctagataagccttctcggaattttggctcctatttgaatgatcaaattgcgtttcaaattctttcgaatttgtgtggaatctgtcgaaacagggcgtattattgtctggtttgtccagattatctgacacagacttttttgtttcttcaacaactggacatctcttttcgctttgatgtccgtttctcccatgacgtattttcttcaatccccttttcaaattatctttgaactcatagaattttctattactgaacagggtttcaaatttagtgtctcctcggaaaaaagaactctttccatctgggcactcatattttattggagttgtgaccaaaggacaatgaccagaatcaagattagaaaatgtgtcagcgggattaggttttgcaaagtcacgcaaatctaatgtatcagaatgcaacagggatccatgcgcagtcgacggcctcaaccattctctaaaacgttttcttttcaaagactcaaatggtctagcctttggctgcaaaatagtttccataattagctaataattgaatagctcttcaccaaaaaatttgcgaactgattcgaattataaagaaagccaccaaacgaataggcaaggaggaagaaaatagctatgcttaattatctatttttcaaataaaatcagggagaaaggaaagtacaaataaatttttattcgaatggttttgttaatatgtatttattttatttttgttgcacttttttgtcgaagaagtccccgatttttacagtgtcacacttaacaaattttgcgtcggaccagtttatgtagcccttcagaaaaatagaaaaataaaaaacctgtcataattcctagttaatctaagaagattaaaattcgtgaacacaaaaagaaaaaggcaagaaagctgtccaaattattacgataaatcaatatatgattctattgtggtatttcaagaactagcttaccaacagtttttctactttctatgtcagcagctgcagttctataatcccgtaatggataagttttgtatattttgatgttcaacttctttgaattaaccagaccaaaaaactcgtcagagtaatatttccattcttcaggatcggcgatatagccgtaaagttgaggtctcaccaaagtaatattttttggggaaagtctggtaatagagaatggcgggataagaccagatgcattaccaaaggaaacgaatacaccttttctttttagtgcggctaagctgatttcaaaggtatcctttccgaccgagtcaaaactagcatcaacgcccttaccattagtgaattttaaaacttgtcttaaaatatcctctttcgaagcgttgatcaagtattcggcgccgtattccttcgctattttaagcttttcatcagttgaggcaactgcaatcgtatgtgcacctttcatcttgagtagctgatttaaaatcaatcccacaccacccgctgcggcaaaaagtaatacatagtcgccctttttgacgtgatacgcttcgtttgtaaatgataaagcagtgagaacttgtaataaaccagccgcataaagtttcaactcttcgtcactcgttccctttggcagcttcatgactgggccttgggacgaaatttttgaatactgtgcaaaagttgagttagatatataagcaacttggtctccaacttcaaaattagttacccctttaccttttgctacaacggtccccgacgcttccctgcccaatacgtatggtttttcacagggataaatacccttccgaaagtaactttcgatgtaattaacacccgtgtacttatttttgattagtaactcttcctccgaaatcgatggtacaggataatcctcatacttgattacatcgtatccaccaatttcatcaatcaaaatgactttttgctgttctggtatagtacatttcatttttgtcttgttgttagcgatctcgtctcttaatgcttactagtagcttcaaaatatctactttgcaaaccgcaaggagatctcactttcaagatatagtatttgtaagaggggaagttaacgctcggctaaatcgttcggatcgacaccgagcggcacgtactatattatccgaactgattactcatctagaaatgaagggtgcaacttctaatgtcacgcaagaagtgaaagtattattcatgttatacctgaataataatcatatgtaggagtaaatctttgttctgtgaacataactgaaaaaaaatcagttcatcaatgcttatcaaccacttgagtaagatccgaaccgtaaggcacttttctaatattaaacccgttttatccaaggaagtttcgcgacgagtaattgttgcacctgcatcacacttcaaaacctccagtccaaatgtgaaaagtaacatccctattcatgaatataaacaactaccggaagattctaactacattgaaaagcattataaggaactacaagtatttttgaatgagtttttgattaagaaattaaacaagacctatgcggattttgaaggagatccagacgagttggtatttcaattggaaaaattcattgaactagaagttactccgagatacacaaatcattcagcacctgatggttgtgaagagagattcaaatccatcggagacaggatagtcgttgaccgctatttagattttgtgaaagatgtcagactaacactgctgctaaatggaggacactccttcatatttgatgtcatgctacaagccaaagaagtatttgacaaaatgcagaaagaatgaagaaagctataaaaaatttgaattatactcattcagttagttttttattagtaatgtacaagtaaatagcgtataatatataaaggttttacgtttctctcagtatctgggaatgccttattatcgatatacacaagaatttctggaagaaatatttccttgctgcacccatacaattctaaacccaaacatgtttcccgctttgtttttattccacactcggcatattgcgtctatgaaaaagatgcgaagtgtctttgtgaaatgaggaagtgttctcgctagagtccgcctggttccacgccaacctttcagcgggcaagtccaatagctttacgtttcccttctctgctgcgtctgttgaaaatctataatcaataggtaaaatagtgataataacatagctagtacaatttacatagtagcatttgctgaagacttagaggaaacgtatcaagccagggaaaaagatgtccactgaattaactgttcaatctgaaagagctttccaaaaggtatgaaagaattataacctgaatgaggtaatcaatgaaatattcagtacggaaaggaaaattgctcgaggtaatattataattttaatgggaatttccagatttatcaacataaacgttagcaagcgcagtaccatcaagtaaaagtttactggtgaaaagcaggacctcgaatgattgagatttcgttacacagtacgagtaaaatataaattatttcaagaagaagagaacttttgatctgaaaatgaaaatgtaaccacggagaaatgttgagaatacataaataaccatgaggccaaaacaccttaatatgaagtataacttttactgtgctcaatgactatttcacccgactaatgccaagtaaggaggatctccatcatacggaacaattttccaaccgccacgacacagttaacgatttccttttcgcctaaaaatagtaggaatgaagttcatgattatattttagatcaaccggtttactaacatgctatttttcatacagcaacctcacatcttcaacaatccaaaggtcaagacttccaagagaaccaagagatggtataagaatgccggtttgggattcaagaccccaaagaccgctattgaaggttcttacattgataagaaatgtccattcactggtttagtttccatccgtggtaagatcttgaccggtaccgtcgtctccaccaagatgcaccgtaccattgtcatcagaagagcttacttgcattacattccaaagtacaacagatacgaaaagagacacaagaacgtcccagtccacgtctccccagctttccgtgtccaagttggtgacattgttaccgttggtcaatgtagaccaatctccaagactgttagattcaacgtcgtcaaggtctctgctgctgccggtaaggccaacaagcaatttgctaaattttaaagaaataaaattaacaagatgatataataataagtggaggataaaacgtaggacttctggtgaattatttgaaccaaagtgtcgtatattaggctctttttctttttcttttaccagacttggtttttttctctctttagtaattgtttctatatatggcttatcaattctatatattttttaacttgaatatatgaatgacatctttaataatcacatctcggcaaacgactgatgagttccacctgcttattgtttatttcctttcgtacacgccgcgcttggccagtccttccaagaatgtaggcagaagaaatcaaactaacttgtaagagaaagaataaaattcattatacatataggtaaaataatataaatacaacggctccatgtgtaagttggaaataaaaacagttggcgtcaaggaagaaaaagaaagtcaatatccggcaataagtgaagacaagatttgccaaattgttacagggctaaaaaaaagataaatgatgaaaaataacgcgtactatcaaacattattgagtttttcgctttcaccaattatattttccggaattaattttctgttttcattgaaatattggagctaaaataatcaactagctctttactgatttcattgattgatttttgcttatagcctttgacctttttcttcattctttcatagcacaatttcaactctaacccatttaatttcatgccaggcttcaaagctgcaagttcatcccaatctacttgagaatcttctgttatacctaaatctcttaatttttcaaaaatccataacatatcatcatcttttacagtctgaattttggcaattgcttcccttttgaccaatttattccatttataacgacattgaatacgtgatctcgtaccgcccatacgctcactgacaatggtccagttaatgatgtctttgaaatctaacttaccgttacccatcaaagatttcctcagtttattattgtgacgtctgattgtatttgacaaacttttagaatgtgtgcttgttgctgatggagcaggtaccattgagttctgggaattatcatcgagctgtatacctaatgaatcgtggggtttgtcttcgtctttgttgtctcccagggatgaagaagcagcagcggcagcagcggcaatagcatcgtcatcatcttgctgcttttgttgaagaagttgttgttgttcttgaatagcagcagcagcagctgctgctgcagaagctgtatcatcatcgtcttcatcgttattgcgatgatcattctggtcatcttgcagtaaatgctgttcttcttccaataagtttggatgcaattgagactgttgttgctgggcttcttccaacatatcgctgataacctttttcagaagctcttcttcttcaacggaccatctatttgatgctctattggtaccacattttacgtagtttctccaacgatccctacaatcttctggcattctgcctaaagttttacctatttctgcccattgaccttctttttctgcacataatttagctagctcttgttcctcctccgcggtccatttaccacgttgttcaaaaatgtgatattttcttctcatgtgtttgtagatagaggagctagatctatagggtaagactttgtaaatattattccaaaagttgtcctttggcctgtcggaactccatatcctttcacaaacttgttgtctagtcaaacgttcaatggcctcatactcgttaataaatctttctaaagcggcgtcttcggctttatcaaaagctttgctattgttagaccttgaagtcgatggcgttgctgaggatgaggataaagataccaaagatgatgcctttgtggcggctgattgaagtagttgagatatttctgaattgtccacgctgccagcttcattatcatgagagggagatttttgttggtgtggttgagtatcttgagagataactttgggcaagacttccatataatttctagatttgttgagggaactatccagcatagagtctttctgcagttcagagtattgctttgtactatttgataaatcatctgtatcatcattgtgattcttgttctgatgattcaaaccgtgtgtacgcatcaaatgatctttaatatgctttaatttttcgttatcgtcagtatcagccgcagtattcaagtattgctggaaatcaggatgttgggtaatcgaatcagcgtcgataatggccttatggaccagttgatcacgatcaatcacatcattattagtatcgttgtcatctgcatcacccaaggtggttaattccggatctacgtttccaatttgtctgtcatcgtcatcattattgtttttccgctttttctgtgaattctcatgattatttccgttatcatgctgtcttttacgcgaattgctatcgttcgcaatactgttattattattgttatttttcgatagagtgtaagcagcagcgacggcggccatcgccatagattgatgatcatcgtccacaccaacacccgcatctttcttattcttgtcgtcgtcgtcatccacgactatgtcagattgagaaaagtgattattactgtcattgccgttgtcagtgttattattgttttcgtcatcttcgtcgtcttgttgattatgcgctgtttgccttaaataccaatccataactgcgttatgttgttcattggagttggcatgatccacattcgaagatgattcgttcgcattcaatgcgctaatattttcagaatcatcattattatcctcgtttctattactgtcatcattgttattaacatcaacatcactactactttccacaatattctgctttttcgagtgtttgttttccagatccttcgtatgcaattgagggtcatggttctggtgatctagacctacaccgacatatttcaaaacagcctcttccacagactcttgatttgcgtttttatcgttatgacctgaaggcatattgattgagctataaatattctaattcagcagcaacacgtgagttcaaactaataacgatagtgtgtagataaccttgcttgtgatgatgtttatttatttactttaggttgggtccacagcagggtaataacagcctgagttttgttgttttatcttgtgtggtcaagaaagctgccatttgtttgtcgttgtcctttgtgagggtaggtcccttggccgcctttggtttgccacccggcatgggcccaatttgaaagacgggtaacaaagttgttgctatatatcacgtgatcaatttttccgaggagcttctagaagaaaatgagacacaatttcaatgtattgaaagtttacgtaaaatttataggagcaggttgggtatactggtgtctatgtaagcgtcaatgtcattttctgtttcagcgtcagtatcagtatcagtgtcagtttccgactcgaaaatgaaggtcgaatgacttgaagttgacgaaggttttacgggggaatgatgacttatgttggataacttgagatcggagtcaacccgaagcacactactgaaatctgtttctcctgcctgtaacaaaacatttcttggaacatcgcgaacatcgtgcccacgctgatagtctccactattactactgataatggcagtggcagcggcagtcgtaataattgcgtcactcgcgacgtaaacgctgttataatcatagaaacttcgcttacttgctgcgttgccaatacagggatctagttcagactttgaacaagggcgctgttcatcagtcgaattcaaccgtgtagaaggaagcctttgtatgaaatgctcatcagttataatacactgttcaacgttatcgttaaatttgatatgcctctctcgtggcttgcccattatatctctccttttgcgtgccttaaaccagcttctccaaaaaaggttctccaatctttgatcattgtccactttcttgtgtttttgtaacggtaaaacattttcattttttacagtgttgttcgagcttctcacatgcttattatttttattgtaattgtttttactactacaattgataaacttgatgaatttccataaatttaaattcaagattaaacttctttgctcgtgaaagtcgaaatttttcttctttactgctggcaacatgcacattcttttcttgtttattttccactgtttggcattcaaagacttgattttttttaagcaatacgtaccatttgcagcggcgggaggatatcccatatcgtttctattcatcaaagttctgaccgcctcaacgaatttactactttcttcttcctctggagggtcctggaataagttatccaaagagtcgcaattactcaaagtcattctcacacactttcttgttcctattttttttttcttattccaatatattattttatcagaagacagacagcaagaacgacagcctaagtttcgagacaacgctaaatttgacggacatgcgaagacatgccatatataacagtacgtccaggaagaagctgcaactcaagaagcaataactattttatgcattattagttaattaaagggggtatggtgtggctaaaaacgagtaaaaaagcagcttgttgcgatgttagtaatgataactataaggtttccgtgttgacacaataagcgtataaatttaatcactccccccacgtttttttatccagtgctgccccgccacatgcaatcgggccgtcggaaaagcaagagaaggacaaactatcgggcaaatggcctggaagggaccttccccattggcccttgactatagtccttcagtccttcagtccttcagtccttcaatgttacagttataccatatcgtacttatgtaaagatatatacggttttacaaatctttgatacggtcgtaaaaggccttcccttgaagttggtgaactcttagctcggataaactgggaggtctgccaccgtcgattccagaaacacatcctgcgccccaggcgcaagacccgttcacatcttcaacgtcggtcaattccttgtatgcgttcttataccccaatgggacataaatgacaccatgatggaccagagtactcattgcgttcatgatacacatttctgtatcacccttgccgcttattgcgcctgaaacaaacaaaccggcaattttgccatggagagaaccctttgcccaaagcccaccagtattcgagtcccaaaagcttttccactccgcggggaagtttccaaacttagtaggtattccgaataagtagtaatcgtactcaaccaacgtttctcttgttaggattttataggaaaaatctgcattagttttggcgactttggctgcctcttttccctcttctgtcgcatattcagttttatagctgacgtctggcacttggaaaatctcagcctcaccaccagctatctctataccttttttttcattttctgctaatgtggcaattatatcgtccactgaataaatcaaaatagcgactttcggcattatctatgtggcgtagtatgtgcttataatagtgagtagtatgctggaggtcttgatgttcgatgtttctcgagaaaagtgtgatataaaatgtggtttctttttatttcttttcttttccgctcttttatgtatttttgattgtccgccccttaggtgttccctccttataactaggcaaccaaaatggaacggctattattcgatgtataaggacaagtttgggagcttcgcttcaatttgcccataagcggtgtcatatgacgctagttacatgcgctggatacgtatgctgcatatatataaacatatgtatatacacctagtggagaggttgtcgctttgtagattccagaggaacatttccgtctagcacgtttggaattttgtagatgcagccaccattcttgtcagtattggttcttacagcatcgttgatttctgcattggcagtggtcacgaagagatctttaccaacaaaacaacaacatgaaactcttggtgtctgctccggcaaaatgaactccttcagcaattttccgttagttaaatcgaacatttgaaccttactggtggaccagacagtgataaacagaaacccagaatgttttccgtctttgctaaaccaaattgcacttccatctggttcaggagactcaaaagattgattgttggagttcttcacgtcaattaactcgtcacgttttagcaagtcgccaccaggacatttccaaatagtgaagtttaaagaatcagtcacgtacatcgtcttttgatcactttcatcccagtggatcgcgttaggaattaacaagcaattccaaacaagctctatcttgtgagctaataggtcaacacgaagcaaacacccaataggttccaaatcaaatggaaaatcgctcattagccccacataaatatattttccatctggcgaaacgttcccatcattagatctcaacttatatgctctgtctgtactcaattcaggacattcggaatacaaaatgacatattcccattcacttttgctaaaatccaattttcctatgccaaatttactaccaaataatacttgtttgatttcattttgtgaagccccatcaagtattggaaatatacagcccacggattcttttaattcatctggattgggagggtactcaattgacgcattcttgccataattggctctactaatggaaaaaaaagaatgactggattcaggctgttctatgtcttcgactttatgaacctctcctttaaaaatatcaacccacaacagtgtaccggtttccttaacgaaggttattccttcactatgtatggcaccgggaacgtgataataaggttttaaatcatgcaaaataatttcttcaaaatcgccaacactactcattttacgaaaagtgtctagttgctcaatgcatataaacttaatctaagaatcttacaggacatcttcatatatgtccatatgctttgaataagcattggcttccccttaaagcccgaccgggtaaactttcacctagctgttcttggcgaccattaaataattttgaatgcatttctaggaacaaaatcaagtgcaagctacagctttacaattatagaatctgttgaccaagtaaaatggatgagaaaatttacgtacgattttgttccttatccattcagcttctcagttagtcaagaggtagctgtagcggcttaacgaaaaaggtattaaaaagggacatactttttttatatcttttcctttggcgttcacagttactcttttagaactccttgttgttgtgtaatgcatttacccattcccgatataactaccactttggagaactgtagacaaagaccgctcttactgagtatacattttactttcgtagaccgacttttaactctattaggaaaagcaattgacttttgaacttcgatgacgattgtgcaaaatacaaatcgtttcaagcggtgttcggaatagctcacagaaatggcgaagatatgttgaaaaatacataccgatgtcatttgtgaaaaacaaaaacacaagctacaatttgtatatttactcaattacatataccaattgagtaataattaaacaagaaggcaaaaataaactaaagcaaaatagtataccatctttggttcctggaccacattttctctcaatatttttgagatgtttttctttactttgttttaagtagtctttccatctcccttcaacggaaacaagtgcacgcaacatgttattttcctgttatccgccctgagcagttttcttccccgggtggcaaccattctccaacattagacaaactttacaaagaagacaccctacccggttgcctccaaagcccttctttcttaacgcgagtaccgctttgggaggcctcatcttggttgtgtcctcgtatggcagcatctgccattgagcgaaccctttcccgttttacgcgcatggcctagaccgatctttagcagacatgccgagtgaatttacctaagatttctaaggactcttctgcatgtttccgaaaatcaccggaaaaaccttcggtttttttagacgaaaactaggaagttgcttagctttccttgtcgtcttcaaatctatatgccatcggaagagaatcagaagagaagatcacgacttaagagctttgctgttaagatagcaagaaagcttgccaataggcagttatgtaacctagtttatctacaccttctttgattaacttagctatgtaggccggtgtgtttgttcatatcacggcatacgttaacacaatgtaaatcttgctttgggttgactgagggaaataactatagacatcacaccaatggctaagggatatttcgacctcgctatgggttctaaatgagggaatggaaaaaaagggtaaattgaaaacaacctaccgattttggtaccacttccgtgattttcgattcttcaatttccgcataatttgcctcaaataggaaatctgagctgtttttttcttaccctcgagtggtcgttctgcggacttttctccggtccaatgcatgaatccctttaagaagcatgaagaaaaaaaaaaatagcctcttgtaaaagcaaaaatgcctttcactatttctgtgtaaacgaataatttcgtcatcttagtagttcactggataattgtgctttccaatcagattagttagtaaaacccctagaaaatttcaatgttagatcgggatgattcctcatcgggttgttgcttattcatgatcctttcaattactggaagcttaccgaaaagatatataaagaaccgaacttattcggtttacatgtaagacagtgtgttagttatggttttccgcccttttcttctcttgttttcttcgatatttgttattaaccttttctcatttacgattatataatcaagtgtcaagattgtgtcagcaaataacagtaatattccaacccgaaaaaaactatctatttatctttggatactttaacatagacaagaagtcctaagaacttaccataattttttttctaaaaacccttttttactcaaaactaatagcttattctggttatttttaatcaatctagaatttttttcttttaattccaaacaatctaataacgtttaaccactaattctttaattattaatatttaattttaaaaatcttctaattttcctgataacttaaagtgacactattttttaaaaaaagcatcaaaatgtctgattatgttgaactattgaaaagaggtggtaacgaagccatcaaaattaatccaccaaccggtgctgatttccacattacatctcgtggttcagactggcttttcaccgttttttgtgttaacctactattcggtgtgattttagtcccactaatgtttagaaaaccagttaaggacagattcgtatattatacggccattgctccaaatttgttcatgtcaattgcttatttcaccatggcttctaacttgggttggatcccagtcagagcaaagtacaaccatgtacaaacttctacccaaaaggagcacccaggttacagacaaattttttacgctagatacgttggctggtttttggctttcccatggccaattattcaaatgtctctacttggtggtactccattatggcaaattgctttcaatgttggtatgactgaaatatttactgtctgctggttgattgctgcctgtgtccactctacttacaaatggggttactacaccattggtattggtgctgccattgttgtttgtattagtttgatgacaactacattcaacctggtcaaggccagaggtaaggatgtctctaacgttttcattactttcatgagtgtcatcatgtttttgtggctgattgcttacccaacctgttttggtatcacagatggtggtaacgttttgcaaccagattctgctaccattttctatggtattattgatttgttgatcctatctatcttgccagttcttttcatgccattggctaactatttggggattgaaagattaggtttaatcttcgacgaagaacccgctgaacatgttggtccagttgctgaaaagaagatgccatctccagcttctttcaagtcatctgattctgactctagtatcaaggagaagttaaagctaaagaagaagcacaagaaggacaagaagaaggctaagaaggctaagaaggccaagaaggccaagaaagcccaagaagaggaggaggatgtagccaccgactctgagtaaatgctttgatctgctgatgtagcaatgtttttttccttctttttcctgacgtattattatttgagaccgaaacttcgctggaaaagaaacacttcgatcctttttttatcttctgcattataacgcgcaacgatgaagtgttaatacatgaaagaagatgggattggattgtagcgaccaaaggccacaaataaatatgcactgtttttaaatttttttttcattaaaaaaatacgaataaattccttaaacacatacatcattttgcttcaaatttttacgtttgtaagaaagaccatttgttgtcttaatacctatgaagcactacttataatcttaattaaatctaattcttttctttaactttttttttgagcatcgcttctatcaattatgtgtatacatacatacatacatataaatatacgcgcaggctaagtagaaaacaacgcaagatagaattactttatttgtcattcatcaagcgcaataaaatctctctaggtgtgcagtattgcatttttacgttcttggaggcggctatccattcgggtccgtaagtaggctcacattgatcgaacatattgtagagatcaacagtatccttgcctaaccttgcatatgtcctaaatagccaaacccatgtatctccgtaacgcgagcactttttcagagctctttctaaccattttaatgatgtttcatattgcgcttctgcataaaaggatactccaatctccaaaagaacgcgatgatcgttttgtgtccttcttaaagcatcttgaaaaattgttttttttaacgaacttttgtttccatgcttaaacagcttgatttgctccacccaaagtaaagcattgcttggaaacttttgcaatgcctgtgtgacgagtaactccgcctgatctaagttaccaagtcttatttccatttggattttagcaatgtaaaataatacatcgtcaggattttttaacaatcctctatctaaaattgatcttgcccttactggattttttagatcaatctcgtcaatctttgatagggaaacccataataaagggcaattgggcactaaccttgtaccagacaaataggtttctctactcatttcaatattgcccatggaatgataaatttgacccagctgtaaaaaaaatttgtggcagatgggaaatgatttcaaacatctctcattcaagaattttatagcctcttcattcagatcttggtaccgcagaaagtttacgtatttataatataatctttccgtgccactgatcttaaaatcctctaaagaggagaaagtttgctgaaaaaaatctcgtaattcatcaagttgtagtgaacgacctaataactttatcttgaaaaagcgtaaatccaaattatgcggggcgaaatctataatctggtcaatcaaaactagtgtttgcctagtatcccctttttgggccttccaatattcgcttacatacatcattaacaagccagggcttttctccctcatatttgctcgtatatcatcactattcttggtctgaaatagcagctcctggaaaaatgctaataactcttcaattttatggtagctttcagtggccattttcagtctagaccaaagaactgtatcacaaggatcccactgaataagcttttttaagacagcaatttgtacctttgagtgtggcattttttctaatatctgatcaacattattcaactcagactcatactcgccactttctcttaaccattctaatatagcgtaaacgatggcttgacaggttaaatttgaattgggcgcatcatttagagcctctgcacgtttcaaccatgctgacaaggtcgctttgtacccatttttagagagttccaataaaccctccttgagcaaactaactagtttatctacaggtatatctgggttatttcgttcttccaagagtgtagagataatccaaatttccggttcttgcggaaggatttttctgaaggaattcaaagtcattttagcattatgatagctttgcaaattagtatatgcagtcaagagatccatactttgtggaataaattgtgtggctttctctaacatttttataacttgcgctttgtcagcttcaaaactgacagctagcttccataggccctcatctcgaggaatctcttgcagtgcttttctcactactctatatttgttaaccgttgtgctttccaaatcaatagctttgaaccaaagaagcggagacgttggattaaaatttattgccgttgccactaatgttttacagtagtgaacatcagattcgtgtagtctaatgttttctagccaaatatcggagcttcgagggcactcttggcaaccattttctattattttttttgctactgaaaattttcttgccttttcttctaatctggcagaagctatccaaccctgtggatttgttggatcggcctttctgtatgactttaaaattgtgcgcattttctgtaaatcttctaacgttgcgtctgagagagaatttactctatcgttttctaagtcctttaagtaacttagggcatcggtagcagcgttcggtttattaacctgtatagggttacttgcattcttcgttaattgtgcaagattctcatctatttgagattgcaataatttttctcgttcttccgttaatttatttaaatcaacattcccaggtattagcgaatccggtgcagcataagtttttctgtttaattgctcttgaattctatttctcttgtttcttcttgtaaaatctgtggcatccggaatatccatccactcactctccgttacagcagctaatgattctttcaaatcggcaaattgccgtttcacgtttgaagaatcaactgaattgtcatcatccttttcattagctcttttctttttcttttgtgctaatttcaattcaagcgttttgaatacatttgcagcttcatcatcttcatcatctttcggttggctttgaagatggttgttcaaattttcacggtaccttttcggtattcttcttcctttgtcatcattactaaccacttgcttttcttttgttgaaaatccagtggctccacgaccaatacctggtacgtaacctgcaggtggttcttgatccaaaaaagatggcctctccataaaatgtgacgttttcttgctgttaaactctttatgtcaactcacccgtatattttctgaaatttttcgtttttttttgcttaatagaacaatctgacacactataaatgtactggttaaattagcccaaggttctatcaacggtaaagaagacttttaaaaatactttcgttacattatttattaaaagaagaaacgccatcatttcataaaggtctccggaggagctactaaagaaagagtgctgcaattaatacaattaatataagtgtggttattgaaaataactattcatttatacggagggttggccgagtggtctaaggcggcagacttaagatctgttggacggttgtccgcgcgagttcgaacctcgcatccttcagtaatatttttttaatatacattttctctgccatcatggcttaaaaaatgcttaaaagaagggaattaggggggatggatgaactaagacataactttcttttcttcaattcgaactctgttgggaagagttgctttaaaaaagactctctatccatctataaaatttattaaaacttttgaactgcacagaatgattggctcacttagaaacaaatttgagcatttcaaagtttctgaaaagggaggtcaaaatttatctacaacactaccgaaactaccccctgcaaaggaccttgatagatcaactatctacaagtaccgttacaattatggtgtaaacttgggtgcgttatttgtgctcgaaccatggattttttctaaagaaaccatttgtacaatcgatgggaaagaatatgatagcgaatttgatgctatttcccaacaattgaagaagcattcttctgaagacgttgcgaaaatgttaagcgatcactataaaaagtacattgatcgaattgactgggaatggctatctaaagatgcccatattacagcgttacgtattccaattggatattggcatgtcgaagatgggaagcatttagattcgcttccatttgccccattgagaaaagtttatgagttagccaaaccttgggaaaaacttggcgaattaatcaataatgccaagaaaatgagcattggtgtattgatagatttgcatggtctaccaggaggcgctaattgcgactcacacagtggctcgaagagtggtgaagctgcgtttttccacaaggaaaagtacatgaccaaagtctacaaagatattttacctgcaattattaacacaatgactctgggcaacgaaaacatcattggtattcaagtggttaatgaggcatgttttgataataacccaaagggccaaaaattctattattcagaagccattaataccgttgaaaaacttcaaccaggtttacctgtcataatatccgatggttggtggccccaacaatgggcagactgggttaaagaaaaacattttagtgaaatagtggtcattgattctcatgtctaccgctgtttttctgattctgataagtcgaaggatgccaattccattatcaaggatttgccaaatactgtgaattttcctcatgaagatgccgattatactgttggtgaattttctggtgttcttgatggacaaacttggaataaaacttctggcgacagagacgctattgttcaaaaatacgtacaaacccaagcagatgtattttctcatgtagctagttggggttggtttttttggactttgcagtttgaatacggtgatggaggtgaatggggcttagctcccatgatgcagaaaggaaatttaccaaaacgtcctcacggtgatgacttacaagtcgacaagaagaaaatagattcaataatccatgaacacgaggcttattggaacggtaaaggtaaaaattttgaacactggaggtttgaggatggcataaagacagctgttgatgatataattgcctttaggaaatttgacaattcattaattggtagatggcattcatggaagtcgcaaagaagagctgaatacgtttctgccaaaaaagatagcgaatttatgtgggaatgggatcaaggctaccaacgtgggttagatgagtttaataagtattaagaaatatacaaacacatatatactaactataggcgtttctattcttttggtttactgtcgaaaataaaaaaaaagctgttgtggcggcacttcgtaagttttcaattatccagctactgccagtagagtactcaatacttttactttcagctgaaatgaggtttttctttaaatgaagttgatacgcaatatcataaaagcaccggaataatggtaatcaagatgaagcgctatgatatttttagtatttgccatcttcaaatcattctattttacccaatagaacattcaagtaaggtgaactatttaaattaaaaactcaagtaacatgggcgatctttaagcatttgagagttattaaaaatttccgaatagagcaataatggaggaaattaagtaaaaactttgagccaaaataaataatattacaaagcaagccagagtctctttttaatcagaggaaagatgagttgataagcgtataagctactctgctgtgaatgtttgaatcaacctcccaaaagatgtattggaggtattaagctgccttgaagttgggatttggcagggttataaaaaaggcgtcattggctaaacatgcagccacacatattgttgtttcatagccataaactttgatataatgaccgaaaattgtttttgcgttgttccataagcccagctgcccgttgggtattttgaacttttgtcgccaggtatcggccgttcctaatattatagtagcttataccatcaagaaagacactacatctaactactcaaacaaaagtaaccccacggttatgttcaccgagttgcgtacggttaacatgtattatatggcagcgcaaaaagcgatggctgtgacagatgatgaagtcatccatcggtaattgtccatcttaggtaacaattgcgaggcaagtaacacagactctcgagtacttgtttttcagggtgtgagaagagccgttgtttacttagtgataattcacgctattttgttgagcaagtcattaaacaatctactacctgtagctcgtgagtggaatatcaaggtgatatacacttttgtgttctaatgaaattcaaatactaatattgacgagttttcatattactagtatattatcatataaggtgtaagagaatgacataaagattgaaaaaaagtcaacggatgtaatggaagctggatgacaacttctacaatgaaaggagaataataatgctataatgtcgaaatagcaactctctttgtgaattcttcgcgtggagtaattctagtgtcttttgtattcacaatattatagcgtttgaaaaacgatgtacttccaacaattattccaaaattcatctatttctcaatggtaattcctattgatcaattatttttcaaaccactcaatttaaaaaattgtcagaaataccatcaataaaagggttttatagtgtagtggttatcactttcggttttgatccggacaaccccggttcgaatccgggtaagaccttatttttatatattttttcatgaattatcggacactcttagaatggagatctcgcagatatggggctgagccgtgctgcatcagttaagaaagaaataagccacctcgatgctgtggtgaataatttacgggaaatttcttggcgtttctgtaagtgacatgatccgttatagtgccgcaaagccaaaaatgtcttatttttaggttagcatcttttcagcctcgaaaaatgcttgttcagcaataatatataaaagtatcagtaaaacaacactttttgttagatgaacaattgattttgtctaggtccttgtactttgagaaatatcatcaaaaaaaaaaagtgcgacatcacaatgagacatcaatactatcaaccacaaccgatgtattatcaaccacaaccgcaacctatatacatacaacaagggccgccgccaccaagaaatgattgttgttgttgttgtaactgtggcgattgctgttcagcaattgcgaacgttttatgttgtctgtgtctaattgatctatgttgtagctgcgctggcggcatgtaagctgtggtttgccttgtaagctgtggtttgccttgtatcatcatgaacgcttttcttcgtggagtagtcttcctatattgtttccggtggttaccatcaagataatttacacacacaaaattttccgctgtacgtttgcgagtggcataacgaataatatgtatcctatcatttcaatgaatcacagctgagcacatttgaattttattgttaaatggaatgccgttaaatgtattatgtaatatccataaaagttcacactgattgttcacttttatgaacctctaggattaaaagtacgtctttgttaatgaagccagcaaaaaatggagaacatcaggaacaaagcggcatagctttgatcttgccttgatgcttctaaaaaaatatatacgtttgtaagtatatactccaattttcaatagtattttaatgaataatttttataaatagaggtaagagattagacacgttatctggaggtaataactaagtaaataaataacagctacgttgctctttttggaaaaagcataaaactcagccatctaagacaacatacttaaaaaagtaatagtctttgatacattcctcgtgtaggacaaaagcaaaaattctcttccgtttatttttcatgaaaaaagcttgtatcatatacacatatctatatatttgcatattattctttttcgttttttagaattagccatatgttctcgataatgagtaaacctctttcaattagcaacgtcctcctttgaagactcctttgaagccaaatgggcttccaaagatgcgattttttctcttaattctagattttcttttttggccaactgcagttcaatttgggtctcttttgatctgccatatgctaacatcttggccatttctttgttctcgtttgttaagttttctaatcttaccaccattttgtgagcaatcgattctgcatcatacctgccatacttagtcactgaatttgttggatttagcgccagtgcagttaatatactttccagattttctttcgtctctgctaactccttttcctttgcatgcagtgacgatgacagttttctgaatatcacttccaaggaagctggcaattcgaaagtttggggtatatggcagttttccttctcatacttatgctcattctgcttgtagtttagcccctcgttgaaaattttctttagcctttgaatttcgttctcgagtgattcgatttgactttcctttatttgtagttctacttccaatgcttccattctgtcatctttatttgaattcatctcattgctgttgacattattcattgagagcgctgtcacatgattaaaaggaacaaatgaattcttgaatgccgtactattgattgaggttttagcggtcatattagacattgatgacatcgagtcattaggattcccattagtatccttgttatttgtcatattattcattggatccagccaataatcattagcagttgccccattcatgatattgttatgattgagagtatttctcatagatgcttgtggtacattctggtaattataggtattcattgatgggggcatgttgaaatttgttgtactgttcaagctatgttgacccgttaagggactagccgacgaaccttgaggaagcatggaattattcattttactcgcctgacctaaggtgttcattaatcccggcctggcatcgtttctttcaccagattcgtatagggcttgttgctgtgactgttggtggggatgaaatgccaaattgttaaaggacgtttccaacgaatgttggggatcataatcataagccatgtaattcatttttacaacagtattccaaacgagccgtgtatgcaaaaagaatgaggtcaaatcaaaagatcaagtaccaagccagctgattctcttcttactaagtttgactatcgtttacatttcttgcttgttgtttcatcaaacaatgtactcttttcttgttttaaatgattttttagcggcgaaggtaacagcagcaaaaaaaaaaaagaaaaaacattgcaaaatagctaatggaaatggatttattactgaaatatgtagaaatatttaactcgatagatttgatcatacacatataatgcaaaatatatatatatatatatatatatatatatatatatatatgtgtgtgtgtgtgtgtgtgtgtgtgtaaacgttcttttagcatcttgtatagaaataaatataaccattttttttcatatcttcaatgctgtcggcagcaactagtttctcatcgttataaagaacccacttccatttgtctgccactagtttacgaataaaaacaacatagtgaccagaatggacagaatttcccttatgacaaataactgcagttaaagcgtacggtttagcggtcgaatatccaagatcctttttttgttgctgttcttcatttggcacttcaggttcgggaaatgttccatcatcatccatgttgttaaatacccattcaacactacgattaacatctccgttgttgagtatcaaggctttacgacataagttgggatttagtcccatggataacattgaagtcaatgatacctcatccacttctctcttatctttcttggggacattaggaggcgggacaaagggatcatttaaatcagggtcatccatatgctggaatagccaattcatagcgctctcagcgtcttggtttccggtgttaaatagggcgcgcacgctagcattttgagtaaagcccatttcaattaattgagaaatactgcattggtttggcgtaaaagagctacggttttcgtcctcatcaggcaataagttttcagtttgaggatcaaatccttgtgataaataagacgaaacatctagcatatcatccctgtctattaaacctggtaaagaaagctcattacttgtcttaacaggaatccagttctgtaatctaatccttattgggttcaaaataagtgtttgaggaagagatttgaaaccaggttttttatttgcggtaaccttttccttacaattagcacatttaaattcaatcgtctgcccttcaaaatacgccttgattctctctaacatatcttgaggttcatcattctcctctaagggaatctgtatagcctctgtgggttcataagaatatttaaccttcccgcaaatgttacattggagcctatcctccatcataaatctaactaaatcgttgggatttggaatacctgaagaactacttgaaaaaaatttcttgtctaacaagtctaaaaggaaggttagaaattccatcgcatcctgttgtctattggaactgaattcctgatgattttgcccaatgcatttcttgaaagtagtaggtttgataccatttggatatagttcgggttcacatttcatggcattgagtagcttgatccattggcactttaaattattgtccggatatacaacatccagtggaaatttacttcctagaaaatccaaggaccaattcgggacgccaccattcaccaagctttgtataaccgaatttaagtaacaggaattacccaaattgatcagaccacagccataattcttactagcggataatttttcaaattctttaccgctagaatcgaccattctaaattgccaattttcgttctgttccacttgtaattgaactagagtcttttcatccgcaatcttttcttgtatgttaattccgtatatttgtagtgcactgcctaaattaacattatctggaaatctagtttcgtcgtcacatgcgtaacaatacagatcataggttgaagagcttaaagaccctaatttgatagctaatgggtgattattattactccgataatgatccaaagcatgcgagtgaccatcaatcccgatttgttccctgccacatccgatattaccacaatgtaggcataaccagagattttgagtcaaatcacaggaagagcattggtttaaattcacagtattttcgggcttagatggaatttgaaagttttctgtatgtggacaggtgctgatttctaacacccaggagttcttcttatcctcgaagtcttgtgacttcgcctttaatatcttttcaatcttctccaaggccgtagaagaaatgtcagagtctgtcgacttcgaaagtacggtcctgggaacattttcaccattgaacctttgtaaactccaaatagtgttgtgggtgtcgtcttctgacgtctcaattacctgtagctttatttttttgttgttattattttcttctacattttcttgcttaggtttctccactttagcaatagttaaataattggaatgtatggtatcgcaagcatattctgtgactcggatatggagtggaacatgtctgttgcacgtagcttggaaacagtttaagcatatattcaatgaatgtttaggtgatgcattgagggccaatggttcattataaggggattcaaagcaataaatacactcatcttttgaaacgactgcaggaacgttaacgttttctagtactgcttctgccatttctgaatgtgagaaagacttcgggctctctttttggatgaatttacctgtcatctctactgccattgcaagtcgcttttcactgtgatttcatcaagtgataaatttgatctcattccaaacgatgtcatttttcaaaggcacatcaactgttataaattatatcctatagccacaagcaattattagtttatgtattgtgtgtatatttatgtaactctatcctccatgatatcctcctaaattttctgtccccttgcctccagcttatactattattaaccgaataaggatataaataatcattcaaaggaagcaatactttagtataccgaagaaactcaaactgaaaattgtgagaaaaaaaacatggaggaagaatgaatcaaaagaggccattaaataaaagggtaaatgtatgtagtaggtccaataaagcttttccaccacttcttcaatagtatttagtatgccttctgatttcccattacgtcttttagcttccttagtggtgggtatgtacaccatcgagcttttatgttgtgtcatttcttccccttatgatatgttccacctttgttcttccggtttctacactctttatctctagtacttttaaaatggtgtcatttctgtcaaattgcgagcactattactcttcacttaaccgcttctcgttaagcgcgtcaggagtaaacgtcatctcgcacgatatgcttaatgcatatgatttgagttactattgttctatcaatttagtttttgaggaagatatacggattgtctgcgcctctatatgtaacaatgtatgtatatgattttatatgtgctctatttatcgaatcatttctcgcttctaaagactgagaaaaaagatctccttttcccgttactgccaccactactggatgcactacttgccatcgcttcacgacggaccctttccaaatcaagcgattgacgggccctagcgaaggattttctcatctctgatggagttgaggtgctaatagtaatgctgctattgctatccttatccttcgaatgccggtatctttccaaatcgtgcctttgcttggaaccagtcctgtgtgtttcatgcttgccatttgaccgggttgacagttcgtgaccagtactgtggcgcttattctcagttattgcggtggaagcatgaggtgaaactctatacgagtgatgtgaatttggtgctggcgagtcgtttttatttctatgctcttgagttaacgttggtgaagacagatttacttcctggaaattcagatccaatgactgccgcggttgccttgttgatacgctgctgaagtccttgcttttgaattgattagacttactagcatcacttgatcttgcctggtctttatgacctctttcattatggagtggtcttctttcagctgtttttcctctccttgcatcatccaaatcaatatcaatgctttcgctggagaccatactatctcccaattcgtctgttgaataattgttcctcttactggaacctttgcgtccagaaagcttagcttgttgaattgatgcagacgatgaagacgatgaaaaggaggagacagcagcaccagtatcatctcttgataagtccatctcattcaaacttaaatttaaaacgccatttcgattattgttcgagcctttgatagttcctgaaccgccggcatcttcgataccgccagtttgaggctcatttgtatcttggaaagattgctttcctgcatcttcttttaatggagatagttcaattaagagagcttcatttttagaggatgagtgcattggttcatttgcagaatttcctgcaagaattggaggttcacccccctgagcatttctcatatcttctgtggtatgatttgttctatcagagacgtaagtaccattattatttgcattttgaatttgcatttgctgttggacttgcagttgttgctgaacttgcatctgctgcttggcttgcatctgttgctttgcctgcatctgttgtgcctgcaattgctgggcttgtatctgttgcgcttgctgctgattcatggaaataacaggtctcaccattggaattgctggggaattttgacttgggagatatcctgactgggagttcgtggcgtaattttgagaaatattctgaaagttgactcttctattaccactatctccagcaatagttccacccaactgcataggtttattggaccgatccctcccagtgtagaaatttctttggctataattagcaggtcctttgggttggtcctgttgttgctgctgttgttcaactctagattgatactgagattcatctggaaaggtattcccttgtgtacctgtttgattttgagcttgctgatatctctggccttgctgttgttcttccaggaaaaagttacttgcgtcattgctcaattcattcgtagaatggtatgcaacattcatttttggaaagggattattcgatttatgttgtttcatcttattaataccagcagttttctcgttcgccaaggcttcgtctgacccgatcgttgctgcaccatatgatgtgctcttcattgatctgccacctgaagaataagagcttgtgctcttttgcctctgtggtagtgattgggtattcaaacgaggactttgttcagaaatagtcggatcacttgattgtttgaccaattctttgtccaaataagtatctaattcgctcacgcttggataatataactctccaggagttttattttcaaaaattgatttgtcctctatacctggagactggattgtattgatttcttgaggattattggctgtaccagaactgttagcattcgatgttgttcttgacgatttatcttcggacagggtagacttcctctgatcggattgactttctttctcttcttcaagttcttggccgacattttgagatggtattctagaaacagcggcatgaccgtcactagcgttcatgggaagtttggatgagatttcaaaagaagaaagaaacatgtcattcagtaagttttcttctgagtcactcaatttattgttctgcataattttcttttgttgtagctggtacatttgcaattgaacattttgtaatttattctgaaactgcgtatatttagaaaaattataggcaccttccgcatacttatcctcgattggaacttccacatttaaaatctcacataaatggtataatacttgataaatgttcggtctcaaatttgggttttccgccaacatgataatgattaagttgattagttttgatgaatatttgttgacaggaaattcatatttggaatgtaatatagcaaattgacctgtcatttcaaaaggggtggtgaaaaataataatttgtaaaggaaaactcccaaagcccatatgtctgatttttcgttaatgggcagacatctgtaaaggtcaatcatttcaggggacctatactgcggagtagtatgcacatagatgttttgagtcaaaagagcaatatcttgatgagtagtgacaattgggaaacatgtcgacgtggacccaaaatcagctagcttgaaattgtttttggcatctaccaagacattttcaatcttgatatcgcgatggatcaaggacacaggaaggtagtgcatttgagagatagaaagagcaacgtcatacataattttcacaatttcagcttctgtcagtttcgttgacaatcgttggttcatataatctagcaaagatttgtttggacacaattccattagcaaaagaacctcaaatccttgaacgccatcacgacggcgagaggcgttggaatcgaagtattgtactatatttggggcccctttcaatttcttcattacctccacttcatttctcatctcgttcaatccattctcatcttgaactaatactcttttcagacatgcgacatcgccaatctttaagggaacacttgctgtattatcaaattcattaagatactctaggaatttcaccacgtaaatttgagcaaagccaccttctgctaaataatttaccacttcaactttatgtgtgcctacgcagacaatatggcctggagtgtacctctctaccgccggatggcccattgccgaaacgcttctagaagtaccattcgtgatcgacatgatcagtgctaattagaaagaaaataacaggcgacagggacgaaaacaagagcttgggaaaacgtaatagcaaaaaatgaatggcaactaaaattatctctatgatgtcctgtgttgcttatgctcccgaggcaccgattctgattcaacaatgctattgaatttactcattcaagaaagggggttcataggattatggcttttattcagtatttttaagttttttcggttattgagctctgaatagggcattttcagaatggcggggttcacctaaaaaaaatgaaaaacaaatataggtcataactcgtctgaattttcgaagagctcatcagacgtttttcagtagggttatatgagaagttttttagtcgttttaagatacatcactaagtattgttggttatgggaaagcaaagctagcaagcctagtactattacaattgttcgtgatatgtatacatttatagagtatttaaaacggttttcagaagtttttcaagttccgcatacgtgtagggtacccaaataatttccattccagaattgttcttagttatgttggccattttatgttctatgaattctctaagcatcgaccttagagctatctcattagaagcaataaaatcagcggcacagagatggttgaaaagtttaagttctactccagttctttgagtaccacgcttaggacctgtgttagcggatagattccccatattctgcatttgtgtttcaataagcaacttatacatcttcttggagttcacagtaagtgattgtaagacgtatttcgcaccttcagcaccactgctggtatcgcttttacccatcttcatcacatcttggaacgtagactcgactgtcgacggttcaaaattcgaaatatcatgaaagacaaagttgtagttttgggccttcatgttgtcccagaggagcggagcgtaaatgtggtctgtagaggcgactatggcgatttgtctgatgacggagaggaagcttagcatcgtctgaaaagtgtttttccttatgctaggaccatccagattatgcactacaagtattaatttgatatctaaaggttgatttttgtagaaatcaatcatcttttggatctgcaaaatcacatgattgccccagtacttagtttcgcttcttgtcaactcagcggggaccaaaagatcggtaatctctttgaagacgtcacgatagttacagctagggttgtaaccatttaaaataaggcatgggatggaatttacaggtttgttttgttgtaattcattctcataagccagttgcgagtacgcgattttcggagacaagtagtcaatggcaaactcttccaaaaaattacgtttcgaacctacaccataaaataataaggagaatccttgagtcaattcaaaccaatactggggaaacatttttttctgaatttcaaataacttttgcctgggacgtttttgaaaattttcgttgaaaaagtttgatactagggaaaactcttctctggtaacgtcaggtgccattgacatggtgtgccttgacttcgcattagttctgacaatttttctttggtcgaaatatccttcaaaagtatccaaaaacgagcttgctgacttggtttccgaagtttggtagagctttttatttttcggtacaggggttggagtaaaatttctactcaaggttaatttacctggggaggttgagtctttatattcttttaaattattcattataatttgctttaggggcgaagtaaaatcatgattagtggttaaagacttcttagatggtgttgcaggttctggtggctcgggtgaatttgatacaaaattatcatcagtttgtggagtcacattatcttcatatgttgtggtcgctacctgtattttttcgcgttctcttttctcttttatccccgtcttttccatcacctgcttgttgttagaagtcttgctttcctcattgacattacctgatgtatctttgtccaatttcctctttttcttagaggaaattgtatctttctcatccttcttgatcctatcagttaattcttcctgtatctttcttggtcttccacgtttacggggagctttacttggcgttttaggtttgagtgccggatctggagatgtatttttcctttcgttgcctacaagcgagattctttccaacaaattcttctttgatgaatgaattcttctcagttgtctttctccatgtgggtcaaccctttttggggttacattcctgctttttgccggagacgataggatatcattatgctctacaaagtcttccccatttagcatgttatggcaattcgcagtactacaaaaacttgttttaaagatatagcaaataagatcaatgatcaattatcaaatacaatttcagctaatatattctactttgtcttaatttaaaggtggttcctatttctttataacttttacacattgtgaagaataacaattctgcttactattgtcatttccacctcaatgatgcggtgagtgggtgttctgaaaaattttcccgattttgctagactagaaattggtactagctgatccatatcacatttacgcgaataagtcgatatttatgcatggatatttggccttttacgacacttattcttatgatccattgaaagatggttcatattacatataaaggtgccacagcaagttaatgtcacggcagctagtgacgctattgctagtttacacctagatgaggccactggagaaatggtctctaagacagagttgaagaagcgtattaagggaatacaaattgaggccaaaaagctgtcaaaaagactcttgcgaaaccaaaaccagcttcgaaaagactaatttcctggccggtttatagtcatctcaatactagatcacagcaaatccaattaagaaacagactcttgatataaatttttatccatacaagttccgattatatatattcaatcctgaatttttggccaagtatgcccattcaaaaaggcgaaaatttcccttaagagaagtttcacattgctaggagagttcatgcagaaagagaatcagcttaaaaattgaaattctacgttctcaatggtggtgttgagctctaaattattttacaatttcaggattattacgacgagaacccataaaaaggagcatgacctttaaggaggagtaatatatatccaccaaagaagaccggcggagatgagatatatttttttcgttaacagagtgcaattgacaacttgtttgcacttgcctgctaactgttttggtttcaaagatcaagaaaatagatagaacccgttttattattcaattgacatcgcccgttatatcagacgatttttggatcaaaaaaagtttattggagcagaagcaattctgaaatgaaggtcctaatatgaccccaatatgacacataattcggaatctgccacttgtgagttttatcaagcctatgcggatgtttgtgactagttggatatgactgaattaatactttcagaaatggacaaggagatatgtgattctctattatcaaataccatttgaaccttactggtccagctaaaaaagagctagaattcatctgttctagcccatggaagagaaccgatatgattggcagatagaaaccatactgattcgcgtcgtatctagcacaacccacgtaagaaccttaattgacgaacagtcaaaccttcttggcttttacaaccgagaggaaatactaagtcaacatcaaggtggcaaacacaattcacagtatctaatttttcgttatatcacattggaaaaagtattaacgtataatttccatctgctgagcacttgctgccgttgagaccggcgaatttttgaaagaagtgtatgccaataataaattggaaagcccattaaataatgctcttatgttggataagctttcttcggtggaataaaaggcacatgtatcaacctgactttcacttttacttaaccccaagctatgtctccattggccaggtactcaaaagaacaaccgggtttatgtgagcgtttcgaggtttttgtatctaaaaaggagatatgtaatgcgtaaacccgaactgaacaattcgtttgaccaaaaggggctttcctacaaacaagcagggcaataggagcaaggcaaatggatcaaggtgatgcttatgcataatttatacgatggaatcctttgtaatgctccgtactacggtttaccaccaaccggcttttgggttgtaatattgacagattcaccatgttctcaatggttctgtcacaattcgaaagttctattactcgcaaattcgaaagcagatgttttaagagacgaggtgaagtaaaaaagaagaaaaatgattgccatactcctcaatgcttgcatgtaatataatataatataattactgtttcattttcttttatattatacaatggatattctacataaccgtaacctatatcgtttttaatgattgcaaggaaaagttgattttgtagataatcttataatgtagtgacttatttaattgtttgattagaggtagtaatattgcaatcaaactgatctagtgagtttcccgctcctttttaattccaaagctttcttgtagggagggttcgtcgggctttgaacaggatctaaggacgatgaagtgcctgcaaccgaagaaggtaggtcatgataagtggcatctgagtcgaaactttgaagacttccacaagccataaattcggctatgtttctctcctcttcattccaatgagacaatttgtctgatatacacaatttattcaaaaaacagccttgaaaaaattcatcaacggatgtatttacatctaattttggtgtccaattggatggtgggttatagcctaaacaaacaataaaagcttccagagatgtacctcttgatgatcttggctttgcgcaaacgattttatcgaatagatagcccaattgggaatatagcatatctatatcacgacctctgaagatctttgccacaaaagttccaccttttttcagaatgcatgcagtaagttgcagcgcactcataattaactgttgttgcacgtattcgtcaagatcgtgtaacccagtaacatcaggtgcaccatcactacaaacaaaatcggccttttcgttgccaaacagttttagaatcctcgccaatgttttaggatgagtgatatcggcttgcaacgttgtcacatgaggtatgggggacatcggttgtaaatcgacagagacaattttcctgtcctccttatctgaactgggactttcatcaaacagttttctcgagagcacttgtgaccatgaacctggtgctgcacacaaatctacaactctttttaagtttggatcatccaggaaatgaaattggtcattgagttgaagtagtttgaaagcagatctagccctatagccctgctcttttgcttttctatagtacaaatctcttttatctttgctgctcttacccatcttgaatactttctttttaagcttgccttgtactcatctactgttgttttacagtaatgttaggagcatcgcttgaaaattttcaactcgcgataattattgttagcgcagaataataatacctagtaaaaagtttatcgttgcttttacttcatcatgataatcaaaatacttgtaggtctgtcttctgtgaaagaagacgtagttacctattctacttaggtttggtgtctttatataatataaaagaaagatattaaccgtacataccccaatcttcttccagttctgcttcagttgtatcaatctcattaatgattcggtggcccataacattatctctgcataatggacatgttgtacttcgagatagccagacagacaaacactctaagtcgaacttatgatggcaatgaggtaattcaactactaaggggtactcatcttctaaataattagtgtaacaaatggagcagttgtcagttgctttgagcttttttttattgattcgtggtaaagaggctgcaaaagtatcaggacagcccgcactcttgcctttatccatttcttgcaaccattcttcctgtaatgattctggaagcatttgcgataataatcgtaaaagtagtgttgaatctgaatgtgcatcaccctcaccactggtgttaccaaagttttgaaatagaccttgcagttgggatcttgacctgtcttctctgctcctcctgtgaagttcctcctacttcttggtaatcccttgagttttgttgtattccatgttcctctaatctaatgatgagtgcagattaaaattcggttagttaattggctttggggaacttacttcataatatatcattacataccttcatatgtagacatttttttgattgtgattatgtttgatgaatatatctttctattatttctttagtagtttaggagtggcaaaactggtattataacgaactgagcgctcctcggtgcaaacaaaagccgcccacaacaattttgaccaacttaggcaaaatgaagccattactagaaaacgaagagtatatatcatcacagtaattcgggtaggagagttggtcaccaaaatgggactcatatggaaggcaaaaatttcgagcttattcatcatggttgtacccgtaaagtttttgtttccgatatatagagtacagatgttttctagttaacagttggcatatcttacattttccggattatgtatcaaataaactttatctatgaatagttagagtaccacagtagaatcgaagttgcgcctttatcattaactaacaatttttttgtgggaaccgaactattatgtctcctggaacaaatcttttgacttttaacccggagcaaattgcgaatccttgtcaaattttgaacttcatcatagcggataagatccttatgaatcacttcatctaatcgctctcgtttttctcggtatgctccagttatttcaattgggatgttgttatcaaagaaaactggtttttccatgaacatagtcaggaaaagttcgtcaccaaattggctttttataatcaaaaacgatttacagatatcacgaatttctctactcacagatttagtattatctcgagcagtgaagcttctcataattgaaatatttccaggcgcgtattgtctgccataatgggagagagatacatcgcatcccataggaactttaaccattgtttcgttaatacttttttcaatacctttaaacggcgtttcattcgcgctatcaagtaatgtattatttaccactgctttaaactcgggattcgagccaggtgatcgcgttaagacctctgttgtataatctttagttaataagtcgtactcatcaaaattgccataggtgaaattttcatcgctttggttcaaagttaccatattttgcctaccaatgctgagaactgactcctttgaatgtaaaactgtggattcctcataatttctctcttcggtaacgtcacttcgattattgaggcagtcttcattaaagtttattacaatggatatggtatcaccagtcttgaacctacaatcatctattttaggtgagctcgtaggcattattggaaaagtgttctttctcttaatagaagagattaaatacccgataatcacacccaaaattattgtggatgcccagatatcttcttggtcattgttttttttcgcttcaatctgtaatctctctgcaaaatttcgggagccaatagtgacaacatcgtcaataataagtttgatggaatcggaaaaagatcttaaaaatgtaaatgagtatttccaaataatggccaaaatgctctttatattggaaaataaaatagttgtttcgctcttcgtagtatttaacatttccgttcttatcattgtaaagtctgagccatattcatatggaaaagtgctttttaaacctagttcctccatattttagttttttatcgatattggaaaaaaaagagctatcagaaatcagtcaatatatcatgtacctatggaaccttatctttctcaaaataataaattatagtgatacttttagaattgtgtcactttctttttatttgtacttacaaaattcggccgagttatcatctcggtaaccgagaggaagagcccgagcagctaaaagcgacaaaccgtacagataaaatgttcgtgctaatccaaactgcagcattccgtataaatttgtcagatatactgatcaacttagataaagttccccactcaacctgcttttgtttattacttgcaaggtagatggatggtcgaaattgatcaaacagttcgtttcttcaacccatgatttttcttacgtttcatctatattgttaacttgttagcgcgaggtttcgatttctttgatctgtccttatgaactttttttgatgtctttttcttgtcattctttgcgttatctgtgctttttgtaggaaaagaaagccctagctccaactgaataagcttattcaaacttaaactaagttttatattttctgcagtgttggttccgaatgacgcagctgaaaagccagacgaccacggaatgataaagattctaaaacggtcaataagtaaaactcctctctttaggccctttggtgtgacaagtgtctcacttattttactgacaaaccgctcccccaattcactagattgaaatcttaggccaccacacttcgccttgtggttgactattaatgacaatgaatttccatccttccatttctttatacccaataattgcgaaactgtatcagttattttccattcagggatcgaggcatcaatattatacagaaaaaatgatttggtggaggggttttttaaaaacgattcattcaagggtagtttcttcaaaatatgagaaatgtccacggacgcgtacttttccaagtttttgacctcatttgcacctttttcatttttatacaatgcagttgtgttttttattaacggagtacttgggccatctgatgttgctcgcagaagtatatttttcaatttatcaacgatattatctgcttctgacggatcactcgtaatctgagctcctcctaatttcacgttttttagtgacagaaaccttttcatcatgtcgttttttgcttcctccgtcataacgttttcctcgttcacaagggatattaaatgatcccgcagttgtatagggatgtgccatcttgaatcaagcatacagcattgacaaatgtttctctgagtggcgcaccgtacacatattaatgttttaatgatattattgcttcgtttagacgtcttaaaatggtataaggtgaacggtaaggtacaaatcttacattcagagccttgtggaattttagtcattcgtatattagcctcatcacctaagcactgctcacatatattgggcggtggctcattaatttcatcattcattatattaagggtgcaataactcttttccgttagctaccttctattcacctgctcaaaagcccttccatcatcattaccacttctatcaataaaatttgccatagcatttcttttttttttttttagtccttattgcctaaacgtcatcacaggagagggtaatcccggaatgaataaggtttgaaacttcacgtccctccgggttgtgacttaaaaaaattacgaaagagaaccgactatcgttcctgctattgttcttggtgagtattactaacccgcttagttttattactatttatcagtcttttatttgtacgttatttgaatatttaaatgtttttggctgagctcactcacatcaactgctagcctccctcctcttccagtttcttttcttcttgtttgcatgagttcgataatgctgattacagttatcatgtctactaaacctctgtccacagccctcatgcggacagatatgatttttttcacctgtatggattctgttatgtcttgaaagatgaccagaagtggtgaacccagtagagcagatcttacagaaatgacgagtcctctgtcctgctgtattggttttcgtagatttcaattttatcacggtttttgtcggtttgcttattttaattgagctatatggatctgatttaccgttaccggtattctctgcttttacaatattaatattttgcaatggcagtatcggtgacgtttttccacttgctgttaatcttgaaatagtcccgtcactcgttctgttcgcttgttttccggagaaaaaatcgaaagcgcacttattcaatttatctttcaagtcatcatcaattagatgtgatgttttcatcaagggtatcagggtttggtatttcctttcattgttaaaagagaacatttcaggcataagagttatctgggagggcgaacattcgaaattgatgggaaattcacatttcctatctttagctagaatagttgacatcaagttgtctttgtaacctatggacatctggaaattttgtagaagctttatattttttgttcttcgaacagtagcgagtgctcatatgacttggtgccggaaactcatttgagctgtcataatatgataaatatttatatgtaaaaatttaggccagataatatataaaagataaacgatttaaagagggtgtaggatttgcctgttagcgatgtaggagctactgcacgatgtagcatgtaatagccagacgtgattcccctaaactcaggcccttctccaaggagaatgcaacggtaggcagttcgtttgaaattgaaacttttctcaacgacaatgatgtcccgcagcataagaaaacatgagatcagaaaagcgttgcaaaacgcagaagccacttatcaagagctacggctgcgcgtttttctgggacgtgctgacaaacgagaaaaaagatggctttgtattcagttcaaggccctgtgtatttttttccttcaagaaatttttattttggcctggggtctttaaacggacgggtgccctgagagtactctcgcataatccagggatggctttttcacagtcgtttaacattcgtttatgaagtaaagaaaaaaaataccaaaccccgttaaaagagaaaaaaggtagccgaacattgaagcagcccatgccagtttgtccttgggcagatagttttccgtctggcttgaaaggttatagtctcctttttttcttggcttcgggaaaatacgatttgtttgttattctatatgcagagccgctgctctgcagggatttatgatctcgagtgccattgatcttgaagcatcttttgttgaaaggatttgtatgacatcatacccgaacttttttagcacgtgaaaatggagaagtctatggttttagaggttgctattaaggcattttctaaacttgagggttgtttgatcttatgttggttggttgtaagccagccggtgtagccacgtgttaaatcttgactttttttcccgaagagggtctggtcctgtctattttgtttcatgcatattttttctcaaggagaaagactcttcgctgcgccttggcataataacgtcttcggtagggtccatttttttaacgttggcgatgcccatatttagctcgtttggtcgttccttcgaaagataatcgttcgtaaattaaaaataaaagagagtagttttcgagcaacgagtagccagctggtgccaattgtcaagaaaggaaacatttcttacggattgggaagaagcactaatctcgaaaaagagaacgtttttagaaagttttagaagttgattatattaatgaagaaaaaattttcgaactaacaattacataaagagaaggtataataatggaggtaatttttcaaatatttgttgtaaaaggttcccttttataacaataaagcagctgcacctgcaacaacagcaccgaaagaggcagcgcctgcattgactctttgaccggcattggaagcagtttcgactgtagaagtgctgacagaagaggtagttggagcgacagaagaagaaacggccttagaagatgattcggcagatgatgatggggcagcagaagaagatggggcagcagaagaggatggagcggcagaggatgtagcttcggaagaagatgcagccttggaagaagatgcagcctcggaagaagatgcagcctcggaagaagctggggaaacggaggcaagagcagcagcgatttcagaactcaatcttgtggtgtaccatggcaatttaacaattgtcttagtgatagcatcaaagtccaattcactaaacaaggtagtgtaagcgtcatcggtgtaagtcatgacttgttgatacacactcaagacatcagatggaatttggaatccactgttgccagtttctagacccaagtagtcagaaagatgagagttgatgtcaccgataatagcttgcaattcagcagtttcggcggcgctggtgtcagcgacggccaaagaggcaatggcacttaaaacgaaagcaatcttggaaacggacattttattttatttagcagagggtatagttatgcaatagcaattattgttactgattgaatgcctttataatttcggtccgaacaaagttaggcaagcgagaataattgacgtttgaaagagggctgccaatgtactatttatattaaatggtgaatgaagcaacgcagtacctcaaagaggttggagacatattcacccttacagcaaaccttttttttcctttactggaaatagctcgaagaattggagagaaaaaaagatgcttttagaaaataagacacatttcccggaacaatcaattatttccatcacaatctttgaaagaaagggccaaaccgccgcaataactgccgtaggattcaaaaccacaagtacattcttcaacggaaaagagtcggaaaatcggaaaagggacctcccgaagacattagtctcataattaaggttatagtcaagaaaaaccataaccagatcgtctgatgctctttttgggaatattgattacccaataaggtcattactccaatttgttgggctccattgtgttgagtatcggttgcttgggttttgaaaatcttgctgccgtccggctgcatgtgtgcgccgcaagtgccgagaaagtaattatcaatgtggatcgcaagccaagacaataaatttgttgtttctgtgactatttcatgatggcctcctagtcaaaataccaagaagaagaaaggtttttttttctttttttccctacctggccattcaaaggtgaaatatcctttccattacccaaagaggtagtactgtttaggcggggtttgacaggcgctggaagggataggcaagaataggaacggtttccaaagccatagaaattcctccttcacgttctgttgaagggaggataaagcaaaatttgaaacaataacgacattgtgcgggtatgtatgctacggatgattaatgaatgtatgtaaaaaaaatataaaattacagaaacgaataaggtcattaagggaggggagggcacaagcaaatgtgcttgtgaagtcatacctactcagcgctaaggacatgccgtgatatcatcaaccggctctaatgggaagtgtccagacctgagtggtgtagttaagtttaacaccagaaatgataagcttttctcatcaaagacatattccttagtttttctttattttcttcgtcctcttgtctcattagctctggatcataaatgcgtctgtggaagtcaaggtcaatcttgtcgaggggatttaatagcgtaaaatctcggttgtaaaccatatatccgaagtaaaaggccaaccatattggaaaagctaaataattttgaaagaaggattccgcatcgcatttgcccccattacctaagggggccaatgctacccaaaattgggcaacaaagactaaaatattaaaaaagacaccgtatatggaaccccaaatccctgttgtggccttgtatcccaactcgtctagagaccttccctgtactttcattgcttgtctgaatcgcagatgggacaacattatggaagtccatgtgaataattcactcaagcctgcgatagctgctaaccatgtaaacacgatctcttcctttgatgaagctgcaacaaaagcaatgacgccgaaaacgcaacacacaataagagctctcaagggcctgccctctctgtcaacgtaatctaaaaacttgggtgcgtagccttgttgggccaaagagcaaatcagtcttggaccagcatacaaagaggaatttgccactgaaaccacagaaatcaaaataacagcgttgataatatgtggaacaattttcacaccgtgaatagaagcggctaagacatagggagatgcatgtgtagcggatccgcctgcgcccattagttggtcatcattatatggaacattgaatccaatgaggatcatagtcaaaagataaatcacaacgatacgataaatgcttctcttggctgccaccggagtagattttctagggttagactgttcctgaacacttagtgcaaataattccataccaccaaaggagaagtaagcagtaactaaaatatagcaaacgtttttgaacctaccaatcgatgtgtcacctgcaaaagcacctggattatgccaataagtggccccgatataaccgtcatttccggccccaccacagttgataacaatagaaagaataatgaaacctgcaatcattaaaattttacagcaattgaagatgaattccgtttcaccataggcttttacaccgaagaaatgaatgaatactaagaaaacatagaaaataagaatataaatgtccggatttattttatcattcccaaattgaatagtcatagacgcggttattaactctaaaggcaaaaccgttagccattggaaacagtaaagccatactgtggcgaatccaaatgatttggaaatgaatatggaggagtatgcgttgaaatttgctggtaaagtcggataggttaccgccatctcacctgcagcttggatcatgaagtacgtctcgaaagaaaccaagatgtaaccaattattagcgcagcaggaccaccgtaatgtagaccttttgcattagctaccaaaagaccagtcccaatacctgtccctaaagacatcatgacaacatggcgcgacttcatggactttttcaacttggaatccgacgtgatagactcaacgccatcctctaaatcagacgtattttcatttatttgcttagttcttgtagtgctaccctcggctcttttgaatgaatccgcaaatctatgtataagtttgtcactcccggatttttgcttagaataagttttctcacttgatgatgattggaaattattcccggcactaaaggaacgtatcgatatcgaatcaggagaagtttcctttttcccagaagatccaaaatcttctgaagatagcatttctaaaatcacttgagttttattgaagctaaataaattgatagtatcgaaaaaggaccttcgtttcaacactagctagagatagtaataatctaatggcaaaatagccattatacgtacctaatatatacgtatatatacgaggagatgtgctcatcaaagaagtggcatttcaccctgaaattttttttctttttctcgctgaagagtcattcctagtaaagcatgctacttttcagtatattccattatatttttaactacaagcggcgcagaaaccagaggatcagccactgctagcagcatttgctgctgacatatttaccgttgaaggccatcataaggcagtgttctgcggggagttggaatgtggatgccggttccggtcccacaaaatatgagccgtgagaagcggcacataatgcagcgtgcggcagtgtcagtagcctccttatactcctagatcgaaaaaagggcttttctttttgcggcaccccaaagacagcatttcttttctgtcaattacgcgccgtgtcgccgtttcttttcttggcacatttacacacttagtccgtttctttttttgcgcgttatattctgctatgttttttcgttggtttatatgatgagtaatcaaactcatccatcagtctgcaacattagtaggtgcaaggtggaagctttgtgcgcacaacatgtttgattgcaaagatttttagtagaaataaaactactcttaacagacttaaaaatttaatttaattatgcagatttgtcctttctcgacttgcattaatgctaaaaaacaaatatatattttgttatcctgaagagtggcaacgaaagcccgatgaagccaagcggaaaatgaatggaattgctgttagcaccagaaattggtcatcctcttaaaaaactttcttgaacgcgagctgtttggattttccgacgattctgaattttcatactctttaagatcatcgttatcgtcaactttgtcgatctctgtaagcgatggagacacaaatatgtttctatgtgagtccaaatcaattttttcggctggaatccaaaagctccatgatttgaagtatatcttgtgaccaaaataggcaaacaaaacgatgggcattgccaaataattttggaaaaacactttgacgttaagttttccatgttcattaacaggtgcgatggctacccagaactggcacacaaggaagaagattgcaattaaaactgcaagccatgaaccccaatagccagtttgtgctttgtatccaacttcgttcatcgaacgaccttgctttgccatggcatctctaaatcttatatgtgacaaggacattgacatccagataaataattgcgaaagactagaaattgccaataaccaggtgaaaacctgttcttcagcgtcactagtggctacaaacccaatgcatccaaagacaagggaaacaaaaaaacaaagtaaaggcctgccgtttctatcaacatatgctaagcatttaggtaagacgccttgttctgccaatgataataacaatcttggcccagaatataacgaagagtttgcaacagaaatgacagaaatcaaaataacagcatttataaagtgaggcacaactttgacaccatgtgatgcaacagcaatgacaaatggggaggcatgggatccagaggagtcactagaccctaataattcgtcactgttgtatggaacaagaaagcaaaccaaaatggtggtgagcatgtaaatcagcagaatacggtataccacttttttgcaggcattgggaatagattttgttgggttttcctgctcagcggcagatagaagtagaacttcaattccaccgtagctgaatgcagcataacagaaaaccgtacatacacctttgaaaccgtgggcaaatggaccaggattgtgccagtactcagcaccgatgtatcttctgtcacctgcaccaccacaattgatgataatcgccagaatgacgaatccgattaccatcaatatcttacaggaattgaaaatgaactcggcttcagcatagcctctggacccaaatagattaatgataattacaaaaacgaaaaccacggcaacaaagatgtctgcatttacactcgtccagtacttaactgtcattgccgcagtgaccaattgtaagggcagaacagttagccattgaatggtgtaaaccacagaaactgcaaaacccaacgaagggtcgactaaaatagaaggatatctggtgtaattgccggttagtcctgcataacagagacctaactcgcctgccgcttggatgatacagtaaagcatgatcgatgctattccgtaaccaaggactaacccggcaggaccagctgttcccagcacctgaccattaccgaccagtaaaccagtacctataccggtaccgagactgatcatgactaagtgacgagatttgatcgactttgtcaggttgtttttttcttgggactctagttcggaattacggtctggtggcagctgccttttaaaagagtcgaagaattctttgcatttcctctgtaatatggatttgctgtccgtccttcgaggctccgctgtttgtccagatacctcatcttgtttttctgttattgtaaagtctctcttttgtttttcactgtgtgttctttcatgcaaactgtgcgaatattgtgctggactggcctctttggcaatgaaactgacactatcgtccatttttacgcctttttatcgagaaactatattaggtagctacggtggtaaaggcaccttataatacagcttggttctatgtattaatttcagactattttatggtctgcttttttttacggtcagagaaaagatgaaatagatgccacaaaacagggatatatacgaaaacagcatcttatatacttttttactccaacattaatttccaaaacaggtgagatgaggtaacccattcgaaaaatttaaatgttcagacactgtcaagttaaagaatataacctggaggttttcttttctttttgtccatcaaaatgcactttttttgaaaaaaaatgccttgtcaagataatgtgaagtttactggaagggccctttcctcatcgggttgccggccctgactgaccttttttgtattttggcccgtcccggcgggcgaagagtgagacgacaccaaatagccgtacggcaataatcctcgtgcaaaaatctctaagaccggtgtcgcattatcctttacacaccaaatttggtgccgtaatgcattatgcatacactgtgcaattatgcagacatgaaatgtgattgtttgctttgtatacgtagtaattgtaagtaagtgatttactgatttactttctggttagcagtggtagttttaatgcgttggccggattgtttatattttgtgaagcaatcctggaaattttaagcatcaaagaaggtgcggtgccaccataagacttcaaaaatagttggaagttttactatcctacataaatggtttacttaaacaaggatgccgaaccacttggatcttggtaaataattgtccctcaattcttgccactggacaatgaattcatccactacccaatataatatttttccggtcagactaggagtattaatccttgccagcgattctacataaactatatgggaggaacccaacaggggcaaaagaagttccataattttcaaccaaaaggatattatacagcatgttccaggcccattcaataaaaacagatgaggggaaccacacatagcaaatctgattctaaccacgtgcacaaaagattgtaccaacgttccaatgatggtctttacactttgtaggagagtcgctttaacttccctagctttcatgaattcatagtattttactttgcaatgaccaaatttttttataaagtgggcgaatctttgcctggaagcctcatcagaataacccaagtacacaatcgacttacccagtaaaagatcctggtaattttctagaagacggatcatttcaccagtatgacctcccgatcctaagaatacaaaaatcttgagcggtttctttgacgattttcgtattttcagtaggttaactccatctttcgtatccttttctgtacctgcttgagtgtggaaaaaaggcagaatcgctatcaacctaataacatatgctgtcgatacgatgagcaccaatgacgccaagtaggccgttttcatgatcttcaagtcacttctttcgactttcctgatacaataataaaccgccgattacagttattgcgggcccttgtacatgaaatattaggatggcttcgctaagaacatttttgcttctggacagacagaacacgtaaaaaaagaaacacgaaattacgactaactttcgcgtaggggtaaaattacctaatgcgcgtaattaaaaaaaaaagcacagcagtgtaaattggagcaataggagaaaatgacctgtaaaggaagtattcgaattcactagtgcggatattaatagaattcataatttcgcgcttggctgctcattatattcttgactatttgccaaactgttataaagaagcctcaatattcgtttggtttattgttaaagaaggcgcaagctcggcacgagaaatatacgacgataaagaacataccaactatatattgtgacggcacaaaaagacaaaatacgtaaaatgctaagacgctctaaaaattccagcactaacacaaacgcagacaccaagaaaagacaatccatgcatttaggatccaaaagttcgctaatctcgctgactagcgaatttggccatggacactccaagacgaagcagaaaaaggaggagggcacagctccttctcaattcctgtctcctacgaataagagaagcacatctagtcagtcaaagttaaaaaggagcagcttgttactggacgaaacactgcttaaagactaccactcggccatgaggcacatgcaaacaaacgctgcaaaggaagaaaagctgcggatggctccatcaccaacgcagtcaacgaggagcgaatcagacgccagtctttcctccaccaagagctcgatctcttccatattttcccaagataatgactattccattcacgatttgttgtacgaagatattgaagagatggataaaacagacgctttcaaaattaacaacacaatagcaatcgatgattctaaagctctctttgtcttctgttcaaacgactcctcctcaaggacagcgtctatcgaaacattgcacgaatcaaatttggacaacctggatatgggttccagtagaaggacatcgttggactttttttaatataacctaccataggacacactttgttgttgatgttggacaattcgttaattaagagtccctaaacggctctactagttccaacctcactttgttttttcatttttttatgttttttctagaaccttctttacgtgattctcgctcggaatccgtcaatagaatgttttcagtctccgtttcaatattctgcgcacatcaatcattttcttactacatacactaacattactcctagtttaatttaattgaatttttaactttcttttcttttcatttggcaatttggctccttgaaaacaagactatgggtctctctcataagcctcagggggggaccccaaaaaaataacgcggccatcttgcatgcaccgttgaacctgtagcttacagtaagccacaattctcttaccttcttggcaatgtggcacaaaataatctggttatgtgtcttcatttggtaatcactgggatgttactggggcagcagcaactccgtgtgtacccctaactccgtgtgtacccctaaagaaccttgcctgtcaaggtgcattgttggatcggaatagtaaccgtctttacatgaacatccacaaccaacgaaagtgctttttcaagcattgcttgatttctagaaagatcgatggttattccctcccccttatgcgtccaaaaatatagggtgctcgtaacagtaaggtattcgcacttagcgtgctcgcaacacaaaattaagtaatatgcgagttttagatgtccttgcggatctatgcacgttcttgagtggtatttcataacaacggttctttttcacccttattcctaaacatataaataggacctccattagttagagatctgtttttaatccattcacctttcattctactctcttatactaataaaaccaccgataaagatatatcagatctctattaaaacaggtatccaaaaaagcaaacaaacaaactaaacaaattaacatgtcatttaacagtccattttttgatttctttgacaacatcaacaacgaagttgatgcctttaacagattgctgggtgaaggcggcttaagaggctacgcaccaagacgtcagttagcaaacacacccgcaaaggattctactggcaaggaagttgctagaccaaataactatgctggcgctctttatgatcccagagatgaaaccttagatgattggttcgacaatgacttgtccctgttcccatctggtttcggtttccctagaagtgtcgcagttccagttgatattttggaccatgacaacaactacgagttgaaagtcgtggttcctggtgtcaaaagcaagaaggacattgatattgagtaccatcaaaacaagaaccaaattttggtttctggtgaaattccatctaccttgaatgaagagagtaaagacaaggtcaaggtcaaggagagcagctctggtaagttcaagagagtcatcactttgccagactacccaggtgtggatgcagacaacattaaagcagactacgcaaatggtgttttgacattaacagttccaaaattgaagcctcagaaggatggtaagaaccacgtcaagaagattgaggtttcttctcaagaatcgtggggtaactaaagtgacctggctctatagtgttgtccctctcgcgaggaccattgttgcttgcatatggcttgaaacatatgtcatcacatctgagcgattttacctcttagaattagtttagatatatatgagttgatgaataaatagttataaaaacttgctttggcttcgatatatgaccgttatttttgactaagttttaacgaaggaatctaacctcgttcttgtaattaccaaaatcttcaacaacgcgctgttggaggtatctctatggatgtggcttgaaatatggatgtcttgcctacttctacttctgggaaaggcatttttactcgatcgcgttaatatatgcatcaagaaaataaaaaataaaacgcgaagagctaaaaaaaaaaaagaaaacctactataaataaccgattagaatcgagtttttgtattgaaatggcggtaataagcgttaaacctcgacgaagagagaagatcctacaggaggtaaaaaacagctcggtatatcaaacggtatttgattccggtactactcaaatgcagataccgaaatatgagaacaagccattcaagcctccaagaagggttggatcaaataagtacacacaactcaaaccaaccgccactgcagtcacaacagcccctatatctaaagccaaagttactgtcaacttgaaaagaagcatttcggcgggacctactttaaatcttgccaagaagccgaataatctgtcctcaaatgaaaacactagatattttactatcatgtacaggaagcctactaccaaaaagcacaagacttggagtggtgatggctacgctaccttaaaagccagtagcgataagttatgcttttataacgaagcagggaaatttcttgggtcaagtatgctaccaagtgattcagattctctcttcgaaactcttttcaaagcaggctccaatgaagtacaattggattacgaattgaaggaaaatgcagaaatacgtagcgccaaagaagccttatcacaaaacatgggaaatcccagcccaccgaccacaagcacaacagaaacagtgccttctacgaagaatgacggtggcaaataccaaatgcctctgtctcagctgttttcactaaacactgtgaaaagattcaaatcagtaacaaagcaaacaaatgaacacatgaccacagtacctaaaaccagtcaaaattccaaagccaaaaaatattatccagtatttgatgtcaacaaaatcgataatcctatagtaatgaacaaaaatgcagccgctgaagttgacgtaattgttgatccattactgggcaaattcttgcgccctcatcagagggaaggggtgaagttcatgtatgattgcttaatgggcttggcaagaccaactattgaaaatccggatatcgattgtactactaaaagtttagtgttagaaaatgactcagatattagtggatgccttttggctgatgatatgggtttaggtaaaacactaatgagtataactttgatttggacattaattaggcaaactccttttgcatcaaaagtttcatgttcgcaatcaggcataccattaactggactttgtaagaagattttagtcgtttgtcccgttactttaataggaaattggaaaagagaatttggaaaatggttaaatttgtcaagaataggtgttttgacattaagctcaaggaattctcctgatatggataaaatggctgtcagaaattttttaaaagtgcaacgaacttatcaagtcttgattattggctacgaaaaactcttgagtgtttctgaagaattagagaaaaataaacatttgattgacatgctggtgtgtgacgaaggccatcgactaaaaaacggggcttctaaaattttaaatacgctgaagagtttagacataagaaggaagcttttgcttacgggaactcctatacaaaatgatcttaatgagtttttcactattatagatttcataaacccaggaatccttggaagcttcgcttctttcaaaagaagattcattatccctataactagagccagagacactgcaaacagatacaacgaagaattgttggaaaagggggaagaaaggtcaaaagagatgatagaaattacgaaaagatttattttgagacgaacaaatgcgattttagaaaagtaccttcctccaaagacggatataattttattctgtaaaccatacagccaacagatattggcattcaaagatattttgcagggcgcacgtttagattttggacaattgacgttcagttcttcgctaggactaataacattactgaaaaaggtttgtaactctcctggattggttggctcagatccctattacaaatcacatataaaggatacccaatctcaggacagctatagtcgttctttgaactctggtaagttaaaggtattaatgacattactagaaggtattaggaagggtaccaaggagaaggtcgtcgtagtgtctaactacactcaaacattggatataattgaaaatttgatgaatatggctgggatgtcacattgcagactcgacggttccatacctgctaaacaaagggactctatcgtcacatctttcaatcggaatccagccatatttggattcttgttgagtgcaaaatcgggaggtgtaggattgaatctagtcggtcgttcgcgacttattttatttgataatgattggaatccttcagtagatttgcaagcgatgtcacgaattcatagagatggtcaaaaaaagccgtgcttcatatatagacttgtcacaactgggtgtatcgatgagaaaatattgcaaaggcaattaatgaagaacagtttgagccaaaaatttctaggtgactcggagatgagaaataaagaatcttctaatgatgatcttttcaataaagaggacttgaaggacctgttttctgtccatacagataccaagagtaacacacatgacttaatttgttcttgcgatggtttaggtgaggaaattgaatatcctgaaacaaatcaacagcagaacaccgtagagctgagaaagcgtagcactacgacatggacaagtgcgctggatttacaaaagaaaatgaatgaagcagccaccaacgatgatgccaaaaagtcacaatacattaggcaatgtctcgttcattataagcatatcgatccagcaagacaagatgaattatttgatgaggttatcacagattcgttcaccgaattgaaagatagtattacctttgcgtttgtaaagcccggcgagatatgtctcagagaacaatgacgccaaatatggacacttatatactaaataaaatagctattatttaatcactgattgtatttaataggtttattcttgcacgactcattcaggttcaagtcacatattaagtagggcctattgctgattcaagttgatatccacgttttcactaatttgataacgatacgctgcgggcgcaaatcaaacatctgaaagatttgaatagcctttagtcccaaaaaaaaaaaaaaaaaaataatgtgaaaaattatctacaaggaaataaattgataggtaaagttaaagaatcacggcatgaaattaaaaagtgtattcagatcagttctaaagtaccggaaaacaaatttgagtttgcttctattaatcacctattcgattattacgttactctatatctttgatcatgaacgttataaactcaatctaccaaaagaggatgagcaccctgaattcaatgacttattagaaacagcatggggggacttacagattatcacggcctcttttcatccgtacacgtccaaagaaaatgataaagtacatgattacttgctcaaaagggttcttgaaattacagggaattcttcgtttgcaagtgtttcagatgacaaagaaagcgagagatccatattatttcagcaacaagatcctttcaatgagtcatctaggttttcgagagtgacatattttgaatcttctaatatattagttaagcttgagggtaaaaatcctgaggaagaagggttacttctttcagctcatttcgactctgtacccacaggatatggagctaccgatgacggcatgggtgtagtgtctttactagcgaacctcaagtaccatataaagcacagaccgaacaggactttaattttcaactttaataataatgaagagtttggcctactaggtgcatcaacttattttgatcactcatggtctaatttaaccaagtatgtgataaatttagagggaactggtgctggtggtaaagctgtactgttccgaacttcagatacttcaacagcaagaatataccaacagtctgttaaggaaaatccatttggtaactctatctaccagcaaggtttttatagcagatatgtcaggagtgagacagactacaagatttacgaagaaaatggcatgagaggctgggatgtcgcattctacaaaccgagaaacctttatcataccataaaggattcaatacaatatacctccaaggcatctttatggcatatgctacatacttccttacaattaagtgcatatgtggcttctaattcattggatacagctgaccaaacgccggcttgttattttgattttatcggtttgaagtttttcgttataagcgctaaaacgcttttctattggaactgcatatttctattagtttcacccgttgtggccattggcttgtatttaatttctcgtgatagaatgacttggaaatcttattcatggctatcgtggaccacgctttcctctttcattagccgctggtattattgtccaaaagcttttctctaacgacataattcgttccaatcctttgacgttctcaaggaactacttttggcctatctcggcttttttcactcaagtaatttttaccagttatgttctgattaattgctccaatttttttttcccctgtgccgatatgaaaaggcctatcaattatcgaattgttcattattttatggaccattttactttttacgtcgaagttattgtatagttccgactataggtataccgggctttatcctctctcgattttctttcttctgagcacaatagctgctatattgagactacttgcactagcgttgggaatgagaacaaggaagaggcttggtagagaatgtagggaccatcactccaattacagctcccattctcaaatagatatggaacgagacggtcaggaaaacttggaacaaccccaagatcaacttacatcgtcacaagacgatcaagcaagtatccaagatgataatgtgtcaactacttcagctggcccatcacataatgttgacgaggatcatggtatggattcatcgtcacaacaacatgatgaaagggtaccattactgaaggggtctaatagcatggaggaaggattgagtactagagaaaattctctaaaacttgagtataccgattatgcctggatcattcaatttttgctaattgtaccaataccatcatttattttgtttaacagtgtggatgttatcatggacgcactaaaccatactgtccaggaaggaagtaaggctacatttgatgtactcaggttcggaatggtgggcagtattttgatcgcgctaccaattttaccttttttctataaggtcaactatatcacaatttctttaactgcactgcttttcttgatttccgcatccaaaacgctcctagtgcacccctttaccaatagtaacccattaaaagtaaggttttctcaaaatattgatttgtctcaagggaacgctgccagtgtacatgtccttggaagagaaggaaattttttaaaacctatgctgcaagatttaccaagtataaaatatagctctacacatattaactgtacttccgtaaccaatggaatggaactttgtatgtatgatggaatgcaacctaatttattgagcacgaatggaaatacgaacatcagcagtatggtcaaggttcatgttttacataataaccgaaactcaacagagagatctccttacgaaccaatagttgcagagttacttttggaggtgaaggagttcagggcttgcactttaacttttgaaagtagacatcaggcgaagtcacctgtcagagaaatcacggtatatcaaaagaaaaattcggccccacagaaagctaatatcacgaagacgatcaagtctgcttctggcataaacgaactgcaattgcataaacttgatttcgatcaggaaacttaccatatcggagtccagtggtttccaaaacttttgacggatggaaatgtagaggatgacaagttggggacaaaagacgaactgtctgtttctattagctgttattggggagaatatgattcggaatcggttgtaaatggtaccgctgttaggaaaattccagcatttgatgaattgataaattacgcacctctaagtttttcctttaccaacgaacagaaaggattagttattgtcaaggatgctataattttataattctaattagttttaaatgtaaatttttataaactcaaattcgcctactgggggagttgtccaaaggcttcgcttcttcccacaagaagaacaaaataataaaaaatattttgagaaatttttcgtaacaaaaggaaaaactattgagtttaacttatgaatgtactttactggccaagaatccgtctggaaccattctacggtgctctcttcgtagcgctaaagacagctatagtggatattcagacggtattgaaaatcactaatgatatcagttaacaaagtaagaaacatgtttcgtcagataagttctacactgctgcaagtgcatacaatgctcgtttttataaagtcctaaattatataaccctccagtaactattagaaaatagcacgcaataatgctagcgatatacaaataacctgtaaatctatatatttattaagtataaagataatggtcttggaaatggttcttcagggattgtgattgactatagccggatatcgtttggatcaagagcttggttaagcggatatttaagttattttaatatatcgctttgtccaaaagcaagttttggaggtgggatctcaatttacacgatacagtattaaccaaatcttgatagcaaaaaaatgcaaaatatcgtataagtgaaggcaaagcattgtccaatgtaaggttctgtgccgcccttcccttttttgaaagctgctagatatcattgttaccctttttaatttctacgctattctcggacgtcataattttatagttactgacactaaaaaaagggtcgtacgtcttactggcagcgcgaaaaatgtttcgaaaatacaccttaacacattgaagtagtgatgatttcataaaaaaccacaagaatttgttcgctaatacattaattcggtactagactttattgactcgtatatttctaacgaataaatcacccactcttgctatcctaacagtatttaatattagctatttaaaagccttaagatggactatggctacttttttcccgcacaacgtattgaagaaacaaatggtgtggatttttggatagacagtaatgctgaatttacacagtctaaaagacctgactcttcaacatccactctttcgagggttttaacggacaccacgaatgtatccaataatagtggatcactcaaaagaaaaaccatcaagaacaaaatattcccacaaaggaaaatattgcaacgatagcgaaaattttgactttggtaaagccaacactgattgtaagcatgtgtttaaaagtatttctaagcaactgatttttcttccaaggtgtttccaacatcacagtatccgaggctggatgaaagacagatactccgaatttggttataaaataaaaagaaatcaaaattgtcccccctcagcatgtgtacaggcactatacaatactagtagatccaataccgaagagtcaaaccccaacagtctggattctctgataatgtataaatacatgcgatactctgaaaagaaaaaggaattgatgtgcagattttgccaggggaataattggattctagctgaaaactacctaaaacatttattctttgcgcacggcattttgtctgaatttaagcctcacactttataccatttcgagtctaagctgttaaaaatccagggaaaacttaatttcaaaattcaagtattaaaagagccagagtttagcaaaaaaattttgaactctcttactgtatccatcattccctctcctttggcctactacactcaaacgttgaacgggggatttaggagaatccatgtgaaatgcccccactgcgaaaattggatccgtttgggttggtgtgaatacgatgaaatcattagggattcctttcaggatttcgagtctctaagaaacctcaatgctgattataatgggatgtcgtatattcaaacacgcaatagagaagacattgaaggtatatacgagaattattttacacactacatccaatgcgacttagccacgttccgaacgaaatgtttatatgtccaagttataacaaaagcaattgattgtgtacgcaagatattaaaaataaatgatcatataacaaatcaaacaaaatttgccgctagtaacgaactaaacgattacgagacggctgataaatactaatattcaccatcctagcgaagaaacgctttaaatttataacggttaccatccaaaataatgaacataagcagatctggcaccgtagcagctcattggggaaaaaaaagctgtcatgtagggccctctgagcataataaaaaaagaagatgcttccgttcaataacagcgataggtagatgggggaaaaaaaggagaggaagatgaggcccttatgtacgtgcatatatatgtgcgagtgcacgaaagtgcaccacggcaatccgcgtaatcaagcttatgtaaatggcgtgtctgcgtaaactctgtccctgcgaaaatgtgtttatttatagactgttcgcattgttttttccagcccccatccggagacgcatgaaaaggtgtggcctcgatacatattgttaaacccatcaacctagcttgtagccaaacaaatcagtcaactctctcatagctctttcaattttaattaccagtagtccgtaagggaagctaccttccgcaatgaacaatagcaaaaggtcgctattgggtatctgtgcgacacaggtatgtaaatcttccatttcgtaagtatatatttttgtcttaaaggagtcgatttccacagggtaacagctattggagtgctgttcctcagtatcgttttcatcctctgaccacttatccttaatcaataagctcatcattttcaagttattgaccgagtttatttcgtttatggaatttttcggtacatcgttgtttgacgtcgcataggacagtatacccccattagtggcggttataatcatagacgattgcaaagacgatgtcttgaagtctaccgaatgcaaatcatacggtttcaaagtgttttccagaaaccctttaacgtttttagaatggagcatcaccatattgcttcaatattttggataccgtttgctgctgataactgccttttttttttttcttcttatcttcccttaattaattcattagagtctttttagcttatatgccaaatgaagcaattgtttttctttttcttcgtctctctctccatattcacctgttacccagagggcaccattcatatcattatcaacgtaaaatctgcgaattaccgtaaaccgcaaaaaaaaaaggatggcgggcagtatcatccttcacgacccgggtggctcgtgcgccctccggaaaaagaaatgaaatggagtgcaaaaacgggaaagacgcgccaccgtttctggcccacgcgctcattctcagtggccaggcactagagacaggactgaaaccgcgttaccacaacaaacaaaggcaacgtgcagtaaacaaccatccctcctgggatcgaaatcaaaagtacaaacctcagatcgaactgaaaaattttcggtagcgtgcttgagccggtataaatattcaatgtcaaacacctacgactttcgcaatcaacggacctctcttgcatttttgtatttaatatgtgaagatctttcctctgcattttctttccttctttatctttcttggcttttcaccctttctcttctttttagaacatcatctttgagtacttcggccacttttagaaaagaaattaaataaaagagttaatcgttcattcgcttctacacagtttaatcttttccatttttctttcaacaagtccctttgagctatcaagaatacgtttatttgacttttaaagatctagttttaattttactattattccgcaatgcaattcaagaacgctttgactgctactgctattctaagtgcctccgctctagctggtatgtacacattctccttttttttcatctttttttctttatttgcctctttcctcacaaatctcgagtagattcgtggtcctcttcattcttttcttttttctttgtcgattactgggctttttttcataggtctcgattgacgcggacggacaatgcgaaaaaaaaaaatttccaaaagaggaaacgggtttcgagatctcgtgaggatggttttggaatattcttcaatatttctgcctgtcataggattagggcgagtaatgaaacagaataatacatgtataaatcgatcgggaatactaacactacttttctttatctaagcagctaactcaactacttctattccatcttcatgtagtattggtacttctgccactgctactgctcaagctgatttggacaaaatctccggttgtagtaccattgttggtaacttgaccatcaccggtgacttgggttccgctgctttggctagtatccaagagattgatggttccttgactatcttcaactccagttctttatcttctttctccgctgactctatcaagaaaatcaccggtgatttgaacatgcaagaattgatcattttgaccagtgcttctttcggttctttgcaagaagtagactccattaacatggtgactttgcctgccatttctaccttctccaccgatttacaaaatgctaacaacattattgtttctgacaccactttggaaagtgtcgaaggtttctccactttgaagaaggttaatgtttttaacatcaacaacaacagatatctaaactctttccaatcttccttggaaagtgtctctgactctttacaattctcttccaacggtgacaacactactttggccttcgacaatttggtctgggctaacaacatcactttgagagatgttaactctatttctttcggtagtttgcaaactgttaacgcttccttaggtttcattaacaacactttgccaagtttgaacttgacccaattgagcaaggttggtcaatctttgtctatcgtctccaacgatgaattatccaaggccgctttcagtaacttgactactgttggtggtggtttcatcattgctaacaacacacaattgaaggtcattgacggttttaacaaggttcaaactgttggtggtgccattgaagttactggtaacttctcaaccttggacttatcttctttgaagtctgttagaggtggtgctaacttcgactcttcttccagtaacttctcctgtaacgctttgaagaagttgcaaagtaacggtgctattcaaggtgactcttttgtttgcaagaacggtgccacatctacctccgttaagctatcctctacttctactgaatcatccaagagctctgctacatcttccgcttcttctagtggtgatgcctccaatgctcaagctaacgtttcagcttccgctagctcttcttcctcttcttctaagaagtctaagggtgctgctccagaacttgttccagccacttcattcatgggtgtcgttgctgctgttggcgttgcttactataagattaaagcaacaatttgtgtttctattattactttaatttcttctctaatgatttctttaccattccttttttattatgagacggttggttcatcactgaattttatatgtagataaaattttagtgtcgttaatatctcttttatttcttattgttactatattattactgttttgaagttccagtttcatcaacttttgctaccttaattaaaagaaccactcagactttttaccatcctttagctttacctaatataatgaaatttgtctaagtaacataaaaaaaaggagtaaagaaaaaaaaaaaataagtaaatgaaataaaatataaaaaaattcttactacggtttaaaacaaagtgctcttccgctaacgtttcaagtttctaaagaatcgttagggccttttaacggatcgcttttttaaaacagtaaaacgttatttatagttatttataccaactatttctcgaaattcgtttttaaaataactgccatctttactgctcttctgctccttcctttgacatgaaaaagcaatcagaaagaaatagtctaataaattgttattatgtacacatactcttatacgtataaaaaacggtataaattaagtagatcattttgcgttgtctgttacctgccccccttggccaatctcttggctctcaacttttcagccatagtcattttctttggaccagaagatggagttggggttgctggggttgctggagtagctggagtagctggggaggacccaccagctgttctaccggctagtctctgttcgatggcttcttccatttctctttgtttttgagcgatcatatccaatttagctttatctggagaaacggtcgcctttggtagagtgcttggtgtacttggaggttccctgtttcctgcgcggaaagagtatggagttgatttcttggcagcagcttcttcgatttctctttgtttacgggtagcctcagcgagttcttgagcacgcttctgtctttcagcatttgcaatttcttccttacgccttgcaatggcttcctcgtaacgacgcttacgaacttcttcaattctggcctttttggcagcttccaattcagccttcttttggttgcggatggcagctaattcgctttccttagtgcccgaaacatgctccttgaacttcaaataatcatcatagaccatgaccaagttcttacgatcagccattctggcttcgtattcggccttggcggcgtcgacaatttttttcttcatagcttcataatttgctgtgtctgtttcttgtagcttgtcaacttctttttgcagcaatggcaattcgacctttctcaaagctctttccgtatgatctaacttcttcatagcatattccatacgactttccaattcactcttgttctttgatacctcagctataataacctgtttaatggtgtcaagatctaagcttttagcttcgttagggtcaatgtaaacatgtcccttagcattcacctcagtaatcatctttgtgatttctctttctttgatagcttcaaattcacgtttcttcttttcaattaagcgacggtgagcctcttcttccaatttagcttcaatagcagctttttcttccaaaatacgctgttgtctgacctcagcatcctgttcagcatgtagggcagcatgttccatatgtttttgcttttgctcttgagatctcttgacacgttcgtcaacaatcttggaaatcttttcaaggtcatccttgttcttcttaattaaagtttcacgggcaattctaaccttttccatgtatgaagcattgttgaaactgtcaacatcgtgtaggacattggataattcaagcaacttgttgtggatgtaagaattgcggataataacaggatcagattcttcttccttttcttcaccgtcttcagtttcttgtggcccaagagcttcgtcagtttcctccttttcttcttggacttctggctctgtgttttcttcttcagagacttctttagaagcagttgatgcgaaaatgtcaaatggatctttagcgaatgtaaccttagcagattcatgatcgatggtaattgaaacataatcttccacagcagcttgtaacagcgatttttcgatgtcccaagcagataagtctaacggagcaggtagggtagcgagcttgtataattcggactgggagacagtagtgaatttttgagaggcagcaacaaaaacccttctcataatgacgtctcttaaaggtgcgatgtattggctgaagtaggttttagaagacaatttgactaataaattttccagctgttgtttcactgtgtcgacatcaaagttaacttcaatgatatcgtacaattctttcaattcctcgtcaactttaccataaatggattcgtcttcaataatggattgcaacatttcctttctagttggcttggcgtccaagtttaataaacggtacatacgtaaatgaggatcgtagccaatagatggaatttcgtctagttgggtagaaatagcggataggaaaattgtagaagaatatgttttgaattcttcttccgtggctcttggattggtagaatataacttataaaacttcttccaggcagtagtgtgcaacaatggatcaccggaaacaaagaagacctttacgagattctcgtagtaattagccaaagtagatggtttaggagcacgtttggatattttcattaagtggaaaacatcctcaatggatctataagcctcgtgccacaattccaacttgacagaaacatcgacttgttggaaacgttgatctaaataacgttgcaaggtatcagcatcgctcaagtcaactaaattgtttcctgatttactttgttggtagttagcagcatctaaatgttgacgtaacatttcagctaatctcttgaattcgtttttacgctgatacttcaaacagaaatgcatagtttttttaacgacaccagaataagtaatttccaacaaagcgttgtttctcaataaatctaagactgcacgatatgattcccaagtaaatcttaaccatgaagtaatggcttcatcattgaaaccagccacagattgatctgactcgtaaacagaaatcagcaaattttctggggtaacaccaccttccaaatcatcatcgatttcttgcttttgaagttcgtcagctctagtttgttcagaagcgattttagattcgactaaatcaatgaatttacgtgcaacggcaccgacagaaaccaaaccttcggtagatccttgaattaattttttgtactggtgcaaaccgtcttttagcagcttacctttctttagttcaacaccaatttccaagaatttaaacacgactggctcaacagttgaaggtgtagcccaacggattcttctggcagttatgaaatcatgcaaagattgtaaagcagcttgtttttcgccaacagaaataagttcatcggctctcttaatggcattttcaggacggaatggtgggggggccatcttgatgtttcctgggcgtttgtatggtttattttggaactctctctatagttgtaagtatatctactttcgatttagttcaccaagaaaaatttttcacctggcaaagcttctcgggcaaagcgactgaaaaattatcatctttacccggtgggtgataattatgacaggcagattccaatgacagaataaaaggaaaggatgccttggttttgataattttataaaatttatcactaaaatatataccatagaggaaagaacttgttcactagatcctttctgattggaagggataaagaataaaaatacaaggacatgaaaaatttgaaataattatgcggattgggtcatcaactcaacaagctcgttcacgggatcttcatcgtgccttgcggtttcaatgttggtcaaggtctttttaataccgacattgaagttaggacagctccttgataattcattaataactttaactctaccagcatcgtcaagaaagtttgattctatcatgacgttgttcaattcatctaaattggtcatatttggaactgctatctcattgtcgaagcaactcaagatatccatttgttgaagtaccgaataagctgatgtagtagtcatgatcaataaacgacggtcttgtgggggtttacgcttcaatgcaacctttagcatttgtaaaatgttattagagaatcttggaccaattggtacccaatcaactagagtctctaacgaatcaataacaagaatgtttagtggagatttatacgcatctctgaaagtgttatcaatataggcaatttttgcgctttctgacatgcctgacaactcgttgggagaaattaacctgatgaatgggaatccagattttaaagcaatttcagcggctaaagctgttttaccggaccctgcagggccgtggattaatagagatactaacctggatttatcactctcgcgaacttggcggacgtaacgggctccgttcttcaatattgagttaactcgttcggaataaagcatcattccaccttccacacatgttttcaaatcttcttcactaatcccaaaagcgggagtaacatcgttgagtgcatttaaaaagtcttctcttgttactttaagttttgctatatctttagtgttaagttttgtggcacctttcccgatgttgacggttttgttgattgcaaaagaacttgcactcttcactaaaccctcaatctcagcaccagagaagttttttgttaacgcagctaactcagctaagttaacatcgtcgctcatcatattattttccctcattttcttcgtctgaatgtcgaaaatttggagtcttcctttttcatcgggtaaatgaatttcaacttggacttcaaatctacctggacgcaaaagagcactgtctattaaatctttacgattggtcataccaataaccaaaatattattcaattgatcaacaccatccattttagctaacaattgattaactacattgtcccctacaccggtaccatcacctcttgaacctctctgcttgaaaacagaatccagctcatcgaaaataataatatgtaaggaagattcctcacccttggccctatattctgcttctgcatccttaaataaattacgaatgttttcttctgaagaaccaacgtacttactcaaaatttctggaccattgacgattttgggctctttggcattcagcattgtaccaatctttcttgcaattaaggtcttaccagtacctggaggaccgtacaatagcaaacctttaacatgagaaatacccagtttttctataactgaaggaggaaagattcgacttgcaaacgctcttctgaaaattttagtaaactctttatccaaaccaccgacacccaaatcttcaaacttgaaatccggtctgatcacagcatttgatcttggtcttaatgaatttgatgatttcaaattaactaaaccatctcttcctttgaaaaaattaatttgtgtttgttttgtcaaaattccctttgtctctatcccagttgcaacagcggaggttggttcaatatcacccaaatcgattgcttggacatttctaatttttaagtcaaagaaatggccttggaactccatgataaggtactgggtgggagaaaatatttgagattcgtagcaacgaacaaattgtttggctaactcatcttgatcgaataccgtgcttaccgccttacctctagctctgaatgagatatctatatctattgaaccaagatacgattgcttaccggaatacttgaataaatcaaatgcttttgcttgcacgtcttgatttagggaccaaccaccccaggtacgctggttaccgttaaatccaatggttcccggtggaatgtcgttggagtgtctagttgtgaaaacaaataaattatcgataataatataaatgttattagggaaatcatttggtgagacagcagctacgtttgcgagtgcataggagttatttggacagtttgacacctttaaatggcgtgtacgggtatccatgtttgtcatatctggtggagtatgatttgcagcagcttttccaaaaccaggtatcttgaacatactcaatttataaaggctgaatatacggtactatttgctcttatctttgagagaaacaacggtagtacttaaaggctacgaataagccaatttcatgaatctcgaaatttggtacgcctaacgtatagtgtgataccgaattaacccatgggaaatacctttttttagtgacgctacgcttgtgtaaagagaaaaaaatactaggtgacattttagagagggtactgcagaagtataaagcgtactctgagtattaaagtgcattgaattggaatcctacatcaactacaagtaaatagtacaacctttataagcaaatgtatttaattaaagataaaatattcaactatttagcgcgctcattattgattaaggcgaggaaggctcaagctaaatgaactattgctgcccatattggtatcatcaaaagcatcatccatatccaaaggatctaaaggttgaggcgttcgcaaaaataaggaagaatctccatcattttctgcacccactttggcgtttacagttgttgttggatccgcttttacgtcgttttccaagtcttcttctggaagtataaacgcgcttgcgatcggtttctttttgtatgtggtacttatcttaccagtaggaggtaatcttgccttcgttgcggttttctttgagacaaactgatcctcttctagtaaagcgaaagaattgtcttctgtggaagtcattgaggttttatcatttgcagatgacttgctttgctttgctatataggccttggaacgttcataatctttttgtaataggggaagtagagtattccagaatgaaccagcatccagcataccttttgtaattttcttatacacaatgctgtctgattcttccggttggatctttttggcctgcactttggtttccccgtcaacagtttgaaactgagtagtcagtaactgtaatggaacagatgaactcaaaactccaaactccttttctaatccaagctctctaaaaccaaagaagtcttcaccagtcaattcgctggcaaagtcacctgtaaaaaagctttggctctcgtcttcaaagtttctctcggacaactcctgcaaagttggccttaataaggctctcaaaaagctttctagtttctgtttgatgtcctgaagtttcttagtttttttaccaaattcagattcaacataggaaaatagatcgtctggcctgttgataccgttttccaacagtgttgtttgcagcatttccacatttgttcctctatttaaggagttagtttcatgatgaagcttcaaagtctttatcagattagataggtaatccccggcgatttcagtaagcatgtttattgctgatggatgggcagtttcaaacccattggccatagcaaccttagatatgttcttatgcatgaatttccatatcagctccctgttgtttttgtaatcatgcgttggaagctgtgacaccggatcaatatcgagtgagtcatcaataatagtgtaattataaatgtggttgttaaggaaagcgttgggattgcttctggagttttgagccgataaagggctctgtaacattctgatcagggatattttatggcatatgtgcctaatttgctgaatcagtgtgatattttggttcattttaggtgttagtcctaaatccttgttagccagaaatctgctttgtttgttgataccattttgaagcatgcggtccacggaagcgtcttccatcttgtctaatgttttagtatttactccctcgtatactatgtcaggaatggcgttactaatatcatattcctgtaggaatctggtatcatctaactcaatatcattgggttgcttttcaaaagcttcatttccatttaaagagtgatcattatgaaactgcaattggtcatcgtcttcctgttttagtactgttccaaagccatttttcataatggaattttgctctattttttgacgatatgattctaaagctttctgctctttatattcaagaaaaagctggtcgaaccttttcattctttgtgggtttttcaaaaacgcctctgaatcactatttaattttccatttttaaaatattcagttctttttaagcaaatttccgcacgaactttggcagttacagttttccacacggatatttccaaatcgtctctatcgtcatccttttcaagtaaataagattgggagtcgaccatgtcttcgtcttcatcttcgtcatcatcatcctcttcctcttcattattttccccagcctccttattttctgcagttttatcttgtagtccgtcttccgtatcctttttggcagcatcagcatcttttgatgaatcctcagtcttactactttcctcaaccatatcttgctcttcatttttcccattttcttttatttcgttcttatttacattttcgtgtaccgttacagtagatgaagcagttttatctttctctttttccccctcagggatgacagaagttagtttgtcatcattggttggtgcttcatccttgacggttttagagctatctttttctgacaccttgccattctctttggccaacatatgagctcccatattcaatccttttcttccagaaccagcaacttcctcttcctcatctaattcgtagtctttgtctttttccatatcttcaatttccttttctaaatcagccctgtttcggattgtgatatttggaatcatgcgaatcaactgaagagatttcttctgcatagcaatagcatgccctctcaaaaaatgtgaaggatctgaattataggtcaaacaatttttccatattagcataatatcgtctacaaattcttgtttggagtcatattgaaagcttttcagtttttttaaaacagtattcaggtccatggactttttgatgatttgatgataattgggggcttctcttttgctcactttattcagaaatggtgtagaatgctcagtgtagtttctaagttccaaaacaaccttttcacaggcttcgtataattcctcttgcccaattctttcatccgatgtccattttgaccgattttttctgacatccataatcagatgttttaattcgtaatctgatattcctaattgggattttttttgctggatagatgatagaaggtgctttaatgataaattttcgatgcctagattgactgttaaatctaaattactttgtttggggcgcttgttcccagtatcgctgaatgttgaaccttcaggagtgggcaatttttgattagtatctggctcatcatttgtattttcgcgatcttgttcatcggtagctgcttctaaatcacttcgacttcgtttcttctttcctttctctatcattttatcgctttcttcaagttttaatcgctttatcatagtttctttatcgtattcaaaactgtggtaaattttgttccaatttcccataatttcttctacattatttgtttttaactttgacagtgtttcttttgatattgagatatttagcaccaagcgtcgttcatcgtcaatttcgatattagaagaggaaatagaatcgagattttttggaggatcatcgacattttttacgtctgtactgtcttcatcatagttctcgtcttcatcgtcgtaatcttcatcctcggcgaacttcgaaataccttctttgttttgtggcttctcatttttaccaatttcctcttcctccttctcttcaacatctaatagggtgtattctgtatcattttcatcaccaaactcattacgatcacagtatatataatctatggcgcactgccacaagacgtatctgattttcaaggataagtttccaataaaccttgttccgcttatttgctgcttcaagtcctctagatctaatttgaataagtcttcttcaacattatcactttcgtcattattcacaaaattatcttcatttgctattgcgttatcgcctttatcttcaatttcattttcaacatgattttcattgctgatactggtgttggtattagtattgttattgtccttaattgtttgtgatgatacatcatctgatcgtgtgtcaacggcaggagagaccgctccgtgatgttcttcttcttgggttaatggaaatgatttttcgacatttaatgctatgtttccctttaagaaatagtcccatgctttcagtttgtcttcttcacttgaaatcgacagcaggtattcaagaacgaccaattgctgagaggttaaatagagatcaaaaaagttcttgttaaaaagtttttcagtcaatttaagtaaagctttggcatttgttctttgataattctttattggtattctttcagtcattattcagacttaatttctttgtagtgttacagtttaaagagtaaccaacaattttcactgatccgaagttcaatctgaaaaaaggaaagatcttattgtttgacttgctaaataaataaaagatgtattttgccaacttctccaatgatcttttttcctttgtacatctaacataattgaagacttacgagtgtacattcacttttcattacttggatctgaaatattagaaagttacccgtaccatcaagaatataatcgcagccctaataattattcactggagttagtcccaacaagcattcctgtagagatttatttcagttaaagctggccagcatttgaccaattttcctatatgtacaataaaagagcataaggtttcagtggggtattttacctttaaaaaaatttcgtctttattctaaaaagccaattgaaatatgctaactttcatttaatatatccttgcattggtatttatacagatatattacagatataagtctttaatacaagccgacaccaaaaacaaatgaattgtcatacaagaataatactggaagcacatccatctttagaggaaacatgttttcgttatttcataaaaccttcaacaaatagtagctcgcgtggcgtaatggcaacgcgtctgacttctaatcagaagattatgggttcgacccccatcgtgagtgctttgtttcttccgtgatagtttaatggtcagaatgggcgcttgtcgcgtgccagatcggggttcaattccccgtcgcggagatttttttggctactcctgcagttattcttctgcctccttagtacagtgtaatgctcctcagaatttttgccaaacagagaaccagtcattgatcgttgattacatatactagctatgcgttgaacttcaaaaatttaaataggcttcaccccagaaatgatgttaatgacaatagtaattaacctacagatagactagaaatgaaaaaggtacggttaacgttgacgctccctcgacaagttaggtcaaatatgaaccacaactgaaatatatgcgggatatacccgcgcttgcgtgcatgtaactaagcaaaaattctccatactgttcgaggaaaaaaatgttcatgaatctcccctgaataaattaaattaaggtttacgattcgagttgtttggaaaaaaaaaaaaaggttcccctgtactgttgccaacaatagtcttatatcttatatcagtaaatctatgttattagagatagaatatacatatattttattgtattctttcttaaatacattgtatctaatattcttttcatcgtccaatcccatataaatcttgcttctctttttcagctgagtaaggacttctgtttatacagcgtatttctttgtccattctctggctgtagcttcgtacttgggtctgtcagtcttgtagatatgagcgatttctggtactaaaggatcgtcaggattagcgtctgttaacaaagaacagatggataataggaccttcgatagagttagagctggagaccattgatcctttaggatgtccagacagatgttaccattggcattgatatttggatgatatatcttggttgtgaaggagatctttggtggcttgaatgggtagtcggttgggaaatggatagacaagaagaaaacaccgccggcatatggggaatcggcaggtcccatgatggatgcttgccagtgatatagatcatcgccgactggaccggctgaacatgaagtaggtggatctctagttcaatagcatgttgattttgttagtaaataagagcataagttttaaaaaaaaagcacgcatttgaaacgtggccataactttagacatacctttctagatcacttagttctttagcaatacgtttagaagaagacatgtttttttggatgcttgtttatgtatgtactctatagtcagtgaaatttatttacttgtggcgatagtgattttcctggcttctttactttattttttttcaggatagatttattctctggattatttattaagatgaaaaataagaataaagaaaaagaaagaaggatgaagaaaaaagaaaaatacaggccaaggcctttcaaggtgagctgttgccaggtttttccgcagcgggaaaaatctcgcagaccatgtgaccgccggtactccttttcctgttgctcggccatttgatcctcgcttcgagaaaaactataacaattgattagtgcggagaggaggataggcggtaagatcagttttgtttattgtataaatgagatactttggaataaggacattagccttatgttacatcatttcttatcacgtaagactacttattgtcaaactttttatgaagtcataaggtggacatatgaatagtgcagttacccttgttcaggaatgacaccttgtgcattccagtgagaaaggaatgttgactaaaacagtagctgtgcttttttttttcttttttgcctttttattcttaatgttcaagaaaactttctttccatggaatgtatgaggaccctttattttgaggaatgggttcgaatttatcatgcaaattggcaagaatttactaagtggactatatttaaagagttgaattttacggtgaaagtaaattaacgctacttctgttgttttggaaaagccaagttcaagtttcttttcttgattatttattctcgtaacgatttcgcttttcctctctatatattttcctactccattctgtaaagagcttccagaacaaaatataaataaataaaaaaaacttctcttcaggcaagagtacgttcttcgctggtttcctacagaatcaaaagagtactgcagcttattgtacacacttacaatattcaaaacatgtgtggcctactcggttcctggcaaggttaagccaagtggtgtagttaccagaaaaaagtgaacacatacaagatacgatgcgtaagtacataaggtatgacagcctgtaacaaatccacgttagatttatatcttctaggctgagaatctggcaggttttagcaaaacatatataacttgctctcattaagcgggctcactgcttaagcgattgttacctggaactacaggcaagtacaatagcctcctccagcttttgactctgaaaaaaaggtaacgaaagaaacttttcacacagataggaactattctaatattacagtaaagccagctatggaataacaggtggcatgtgcccactgtattcatgtatgagcggccttttttttccacgaaaacagatatgatgatgttttaggccaaaatggtgagatccttttacaggaagattttacgccaactctttccatttagtgacacaggtgagggtcttttatcggcgcaaggtgtttcagatgagccattttgcccgtagtccggtttaatcagcctcattggaattccccggcaccgctcgcattccgcgtacgactcaaagaatttcccattgaattcgggaatgtgcgtgtttcagattgcgtttgcttattattctgggaaactctccggaaacaagctgagctggactccacgaatggtccctcacaaggctcttggctcatgcacagttaaaaagcacctgtagctaccatcagcaatccatggtgctggagtttctctcgatggtacggcccatagctggagaaaatagcttattaccaaaaaagtaattcccccgcagaggtatatattaagtttgaaacaaaaggcttgcttaattttttacatatgacaacccttttcttacttttataaatgtttatgaaacaggagattcttcgactggtgccagattcctcccatatcgacaagaagaataatccacctatttcaacaattctgatacctgtttaaccatgagtcttaaagaagacgactttggcaaggataattctagaaatatagaatcatatactggtagaatttttgacgtatatatacaaaaagattcgtattcacagtcggccttggatgatatgtttccagaagccgtagtttcaaccgccgcttgtgtgaaaaatgaagcggaggataacatcaatctcatagacacgcatcctcaattcgaactggtaaatactggactgggtgctaaatcggacgatttgaaatctccatcagcaaaggctacgttcactgacaagcagaggaagaatgaagtaccaaatatatctgtgagcaactactttcccggacaaagtagcgaaacgtcgtcaacaacggaatcttggactatcggttgtgataagtggtcagaaaaggtagaagaggcattccttgaggcacttagactgataatgaaaaatgggaccacaaaaataaaaataagaaatgccaattttggaagaaacgagctgatttcattatatatcaagcacaaaaccaacgagttcagaaccaaaaagcaaatttcttcccatattcaagtctggaagaagaccatacaaaacaaaatcaaggactcgctgaccctatcatcaaaggagaaggagcttctacaccttatcgaacatggcgctgaacaaactactgaaaactcaaacctgttttatgacatatttgaagaaattatcgactctctaccttcagtcagtgattctggaagtttaacccctaaaaacctctatgtaagtaataatagcagtggattgtcagtacattcaaaactgcttacgccaatcactgcttccaacgagaaaaaaattgaaaatttcataaaaactaatgctgcatctcaagccaaaacccccctcatttacgctaagcacatttatgaaaacatagacggctacaagtgcgttccgtcaaagaggcctcttgaacaactttcccccacggaactccaccagggagatcgccccaataaggctagcttttccaacaagaaggcaatcctggagagtgcaaaaaaaatcgaaatagagcagagaaagataatcaacaaataccaaagaatttcccgcatacaagaacatgaaagtaatcctgagttcagttccaattccaattccggttcagagtacgaatcggaggaagaagtagtcccaagatcagccacagtcacacaactccaaagcagaccagtgccatactacaagaataatggaatgccctactcactctccaaagtacgaggaaggcccatgtatccaagacctgctgaagatgcttacaatgccaattatattcaaggtctgccccagtaccaaacatcttatttttcgcagctgttattatcatcaccccagcattacgaacattctccacatcaaaggaactttacgccatccaaccaatcgcatgggaacttttattaaatgtctacatacatacatacatctcgtacataaatacgcatacgtatcttcgtagtaagaaccgtcacagatatgattgagcacggtacaattatgtattagtcaaacattaccagttctcgaacaaaaccaaagctactcctgcaacactcttctatcgcacatgtatggttcttattgtttcccgagttcttttttactgacgcgccagaacgagtaagaaagttctctagcgccatgctgaaatttttttcacttcaacggacagcgattttttttctttttcctccgaaataatgttgcagcggttctcgatgcctcaagaattgcagaagtaaaccagccaatacacatcaaaaaacaactttcattactgtgattctctcagtctgttcatttgtcagatatttaaggctaaaaggaaatgttgtcgagactatctttattgagtaactcgagggcgttccaacaggccagatggcgcatttaccgcttaaaagtttcgccaactgtgcatgcttctcaataccatattctttctggtaggaaacttgctcaatctattcgagaaaaagccaatgatgagatacaagccattaagcttaagcatcctaatttcaagcctaccttgaaaatcattcaagtcggggccagaccagactcatctacgtacgtgaggatgaaattgaaagcttcaaaggacagcaatgtagactgtatcatagagaagttaccagcagaaatcactgaagttgagcttttgaagaaaattagtgacatcaatgatgatgactctatccatgggttgctaattcaactacctctaccgcgtcacttggatgaaaccacgattacaaacgctgtggactttaaaaaggacgttgatgggttccacagatataatgctggtgaattggctaaaaaaggagggaaaccatacttcataccatgtactccttatggttgcatgaaattacttgaagaagctcatgttaagttagatggtaagaacgccgtcgtgttaggcagatcaagtatcgtcggaaatccaattgcttcgttgttgaaaaatgcgaatgccactgttactgtctgtcatagtcatacaaggaacattgcagaagtggtctcccaagctgatatagttatcgcagcttgcggtattcctcaatacgttaaatcagactggattaaagaaggcgccgtggttattgatgtaggtatcaactacgtacctgatatcagtaagaaaagtgggcaaaaattagttggtgatgttgattttgattctgtaaaggaaaagacatcttatattacccctgttcctggtggagtgggtccaatgactgtcgctatgcttgtttccaatgtactattagctgctaaaaggcaattcgtggaatctgaaaagcttccagttatcaaacctcttccattacacttagaaagtccagtgccttcagatattgatatatcaagagctcagagtcctaagcatatcaagcaagttgccgaggagttgggaatccactctcacgaattagaattatacggccactataaggcaaaaatttctccaaatatttttaaaagattagaatctagagaaaacggtaagtacgtccttgttgcaggtattactccgactccattgggtgaaggtaaatccactacgactatggggttggtgcaggctttatccgctcatttagggaaaccatccatcgcgaacgttagacaaccatctcttggcccaaccctgggtgtcaaaggtggtgctgctggtggtggttatgcccaagttattcctatggacgagttcaatttacatttgaccggggatattcatgctatcagcgctgcgaacaatcttcttgcagcagctatcgacactagaatgttccatgaagccactcagaagaatgatagtacattttacaagagactagttccaagaaaaaaaggcatcagaaagtttaccccatccatgcagagaaggcttaaaagattggatattgaaaaagaagaccctgatgctttaacacctgaagaagtcaaaagatttgctagattgaacataaatcccgatactatcactatcagaagagttgtcgacatcaatgacaggatgttaagacaaattaccattggcgaagccgctacggagaagggttttacaaggaccactggattcgatatcactgttgcctctgaattaatggccattttagctctatctaaaagcttacacgagatgaaggaacgtattggacgcatggttattggtgctgattatgataacaaaccagtaacagtagaagatattggctgtaccggtgctctgactgcattattacgtgacgctataaagcctaacttaatgcaaactttggaagggacccccgtaatggttcacgctggtcctttcgccaacatctccatcggcgcatcatcagtaattgcagacttaatggcattgaagcttgttggttcagaaaagaacccgttaaatgacaagaacatccatgaacctggttatgtagttactgaagcaggattcgattttgccatgggtggtgaaagattctttgatatcaaatgtcgttcctctggattggtgccagatgcagttgtcttagtcgcaaccgtaagagctttgaaatctcatggaggtgctccaaatgttaagcccggacaatcattaccaaaagaatacacagaggaaaacatcgattttgttgccaagggtgttagtaatttggttaagcagattgaaaacatcaaaacgtttggaataccagtcgttgtagcaatcaacagatttgaaacagactcacaggcagagattgaggtaatcaagaaagcagccttgaatgctggcgcatctcatgccgttacttctaatcactggatggaaggtggtaaaggtgcagtagaattagcacatgctgtggtagatgcaacgaaagaaccaaagaactttaactttttgtacgacgtcaatagctccatcgaggacaagcttaccagcatcgtccaaaaaatgtatggtggggcaaaaatcgaagtatcaccagaagcccaaaaaaagatagacacctacaaaaaacaaggcttcggtaatcttcccatctgtattgctaagacacaatattcattatcccatgatccatcattaaagggtgttcctagaggttttacgttccccatcagggatgtgagagcttcaataggtgcaggttatttatacgctttggctgcagaaattcaaaccataccgggtctatcgacatatgctggttacatggcagtagaagtcgacgacgacggtgaaattgaaggtctattttaaatagtttggcagactcctaatggcatcaattcgacctcgatgtccgtctgcacgagtaccctttatataaacaattgagatgagaatattagaaaaatgggttttagttatgtaggtatatgtgcatacatacgtattatcgaagtttttgctacctgtttattaactgagtatgtatattaagataaattaattaaagaaaatttaagcgtcttccttcaataaagcatctctcttttcagcaactctttgagctcttctgtcacgagcagctctgttcttcaatcttctagcttcagcttcttcgttcaaagccttttcacgttgagcatcagccttagcttggatgatgtgttcaaccaaggctctcttgtgtttgaaagcgttacccttagattccttgtacaaaacatggtacaagtgcttgtcaatcttaccagcatcacggtacttagccaataatcttctcaagacacgtaatcttctgatccagacaacttgggatggtaaacgggcttctctggtaccctttctcttaccgtaaccactgtgacgaccttctctcttagattgagcatgggctctggttctggatttagagtggacggtaacggccttctttacgatggtaccgttcttaaccaattttctaatggcgtttctggagttggcttgagcaatttcagaggtttcatttggatctaaccaaacctttctcttaccgacaccgacgacagaagcggcaagtctcttttgagtacgtaaattagccctgttaaagtcatgttagttattatcgttctgtaagaaggaaaaagtctattcgcgtcgaaagatagaaattgcggtggtagacactttaaaactcgctatagaaaaatgacatggttattatgtatgctggatactgcagcagctcgagtaacttttatcacgtaactggttctcgtattgaatactcatattaatggtctcacttatcgctataaatatcttaatggtaaactgcacagaaaaaaaattcttccacaagtttcctcttttgccttttagtgctaaaactccgattatagaaacatctggcttcactagcatattcatgatgcaaatggaacacagtatcgttcttggcatatattacccatatcacttttcaataacgctggtgtttcaggtgataactcatcaaactcgcattcctcaagagggagttattataacaattctatcttattcctgataaactttcatagattcattattcactgcatcacatacatttttgctttggagttcttaatcaactttctatgtgaagcgtaaaatcaatagttaccttgtattctctgttgatcactgtccaaacctatatttttgtttccccctcagagaagttaggtcgatgcctatcgtagtttgcaaggaagacggcttccaactgagaccgccctagtctggcaggattcgtgaaaggagtccatgccagctgctacccagggattgccacggccccggccagcgtatagtacactgtcaggagcaattcgaagaggcaaccaaaattatgctaagcatcgcactctctctcagtctggtgctaagcggaagacatgcttccaatggcctcctcaccgagaacggatattaaacgaaacgaagaaaaaaaatcttcacggaaaatgcgtaatgtctggatgacaaaatgcatgggtgtaaaaaaggaaatgagacgaacttgtaataaaccttagtgggttgacgaattttgaaataaagtttttcctttttttttttttttttctttttcattgtttggttgccttcaaattacatataagatttctcgagaagggttttccattgtccttttcattaggcgttgaagtgaatctaaagtgcgcttgaatgatttcagatagaaagactaaagaagtggtgtgagtataattaactcaattgaagacggtttacctgaagtgatatactgtgccttgagaaacaatgagtagcgacgctaagcaacaagaaacaaactttgccattaatttcttaatgggtggtgtgagtgcggccatcgctaaaactgctgcctcaccaatcgaaagagtcaagatcttgatccaaaatcaagatgaaatgatcaagcaaggaactttagataaaaagtattccggtatcgtggattgtttcaagagaactgcaaagcaagagggactaatatccttttggcgaggaaatactgccaatgttattcgttattttcccactcaagctttgaacttcgccttcaaagataagattaagttgatgtttggtttcaagaaagaggaaggctatggtaaatggtttgcaggtaatctggcttctggtggtgcagctggtgctctttcgttattatttgtttattctttagattttgccagaaccagacttgctgctgatgcaaaatcgtcgaaaaagggtggcgctcgccaattcaatgggttgactgatgtttataaaaagaccttgaaatcggatggtatcgcaggattatacagaggattcatgccatcagtagtgggtatcgtggtttatagaggactatatttcggtatgtttgattctctcaagccactggtgctaactggttcattagatggttcattcttggcttcatttttattgggatgggtggtcactacaggtgcctcaacatgttcttatccattagacacagtgagaagaagaatgatgatgacttcaggtcaagcagtaaagtacaacggtgctatagattgtctcaaaaaaatcgtagcttctgaaggtgtagggtcattgttcaaaggctgcggggcaaatatcttgagaagtgttgctggagctggtgttatttccatgtatgaccagttgcaaatgatattgttcggtaaaaaattcaaatgatcagttggatgaagaaaaaagtcattttctcgacttctcttcacctttcgatcgatttgattttggccgccaacttgtttatagaaaaaaaatagtaggaaggttatgtatcgctttcttttattttttattatagagtataactgaataaatttgtaaatcagccactgttgttcgattgctttttggggaagtgaacttgagacctttaactttcggctttcagatggttggatagcaattttcacacaatttggacattgtctccaagttttccacaatgatgaaggttctttgttaagtgcattcccccccttttaagtaccttggctatcaattttatacccatttttcgtatttaccatttaattaacgatccaattattagcgttaattacggaagcgccaatgaatttttagaaatcagaaccatagttttgagctcaacggaactatccaggataatttctcaaagctttatcaagatgagcataattttcctttcggggtgtagaccttataagagcttccgcgtttttgttctacattccattgagaaatttgttgccaaagtttgccaatgatcaatggtaaacataacggttctaagactcaaccttcactatttggagagtgatgcttcaagataagcatcctgatccattttataatatttgttagggttttcgagaacttagataagaatcaattattgtcagtattattacattttggtttttaattttaacattttatttttatttttttgacaattctcaaataaatttcatagcaaaaagggagaaagatttcagaagaatacaaacttaggaccttcttatgactatttccaacattctcatcgtcctctcaacgggataaaagttcagttcctgttaaaaaagaataattcttactgagaatgaagtattcaaagaaatttaatatttttgaaatattttttgggattgcgcaaacatatgccctctcaaaagcaagacaaaaatttagcaaactttataacgattacaccattattttctcataattttcgctagacatttctacagtacttgtggacgttggaaatgaaagacatagtatgaaaaagatgatcaatttttcgcaattggttgagtaaatttcaggtcttttttggggatatttttcaactgagaaattcaaaactgacaagaattaaaaatgagaaaagattgcgagcttttctattcatgtgatacatcgccttttaattatatatagtcatgtttaagggattttagagggtaaaacaagttattgaaagggtccgtagtcggctgcgcaggaaatgccctttcatagagcggacgtaccacaacgcgcatgtagttgagcgccgttcctgctctgatcatactatactagacagggaaaaatccatttttaaaacgtgtgactgttttccctgtcggtcccgaagtaagatgaggttgcctaatgaatagcagcaaacgatactttcagtattcgtcctttaaagaattttgcacttttgaccaagacctctgatttgcgagacctcccagttcggatgctttaagacacctccaaatctctagaaaactcaactacaatgcgtccaggtatagagacgaaattaattaaatgaaaaacttatacgtatacgaactatctaccagcctgtaattcacttatttagaatatttatttaaattttttttaaaaacatcaaaagcagacggacaaacgttttaaaccaatgacagggtcatggtaataataatagctttatctttttttatttctttcactttcggttggtgaaatcaagtacttaaaagacctaacaaactctacaatttgcgcctttctttcccctaatagaacatgttagatttataagcgaaaacggaaaagaaaactacagcccagcaataagagtgcaaatcaaagtgtgcatgaagtgactcgtatcgaacaaatatttagccactcgttcaagcctggccggccaaatccaaaagataatctttggcctcaccaatgatattagcgatgacttcgccgtcctttagcacataaccatgtgatttatcctcgcttaaaactgtttgaatttcatagttctttttctcttgcttcttcaaaaactcctggtacccactgactgtcgtcagttcaacaggtgcgctttgcaagaaagaaccggtagaatgagtaaaatttgtgctttgtttgtatagagcagatgacatgttatagtataatgtaatttattgtagttggtaacttgagcccctatcgaatgaagagtgcgccgctttcccttatacaaactggagccgcaagtcctttgtcccttttataataatgagatgatccggtgataactacttattgccagaaaaagcccagatcagataattaatgggggcaaaccaaaacaagaaaaaaaaccgcgaaatgaagtgcgggtcaaaaagaggaaaaaggaatatggataacatgtatgcgcgcactgacgtaactgcacgtacttcagaagcaacatatattcaacaaaactaagcaagaagatattattagctgtaactatatcacatttagacttacccctatcgttcatacttcccactgcaaccctagttgtagttctgctaatagtcggccaatcttgaacatgtactgtaaggcccaaaagggctccagggatgcccttctacaaagcatttcacatgctaataaaagccccgttacataataacatctcccgcccacaaaagcgtttgatcctgtttttctatttgcttccataaaaaatcggatcacatttccttttcttccgccttagatctgcaccgagatcttttgcgctctattttacccctagaaactggacccggcctagaatctttcactgccaccagagagttttagcctcgctctcttttaatttgctgaaaaagggtttcctgatagaagccgcggttaatagaaaaacggcaaaaaagttatggtcggtatgttctacccccctggatataatcgtgtgactaacatacgtaatgaatcctagctgtgactcctctcgaacgaagaagaaagaggcaatgcatgcgtagaaactaaatcttgagatttctgtttgatgaaaacactgcacaaggtaaaatgaattattcttttaaaattagagatacataaaacatacacttgatagaaagaagaatacatattaatttaatgtcaccatattataaaaataaaatttgttatcgtcctagcttttttttaaagcttctttttcagcttatgcaatagcccctttttatgttttggtttttcctttgccgccgatgaagaggaagaggattcggttgtcttagaattgttcgtgacattcttcactccagcatcacgatggcggtggtggtgatgatgatggtggggctgagtagcatctgtagtagtagtagtagtagtattgttattagatggtctcgcagaatccttagtttccttcgtggaaatagatcttgatgggccatttttcgtgcttacttcagtcttttttgtttgttcagtagccactgaaaccttcgattggttatcgttaacagctgcgttgacaacaggcttaatatttgcatctttaatgagtggagtcttagtggcagcatcgtctttggcctgggtattttcgttattttcgccaccagtaacagcaattttgggtatttgatcaatttttctacttagtgcatcaacggcgtcaccatctggcaaaagcttactttccgtgcctaaggtgttgttattggtggcgttggaagattctgcactggatttcgcatccctaatggatttaccgtcctcatcaaaccttaagtagtaatttttagatgttggaattgtttctggtaaagtggcgcccgcaacaccatatgagccaacggtaggcaccttcaccaaagaatttcttttttcagtactttctgtggccaatggctttttaccagcagatccggctgtatcgttatcaacagctttgactacaccggttttgctgctagaagaagaagaagataatgaaggcgaggaggctgaggataaagaagacggatcattgttggcatgagtggcagcatgtgcctcatatccattggcagaagaggcaggctgtttctcaccgagttcttggtgcaacttctcattcgcagacccttttctttgaactagttctttttcgttattcgaattaaattcaggggagggaattttttcaaagacttcttgttttggtgggttttgcacgttaactacatgctttggcacaatgccatttgcaacgtcatcatgggaagatttcaaaatactagagaaaaggaagaaaatagcaacactaacatgctcaataaaaacagcatatagtacaatatttatccacgagtggtttattggatttgctaggtaccaagctttattcgtatggatggaagtatgagcgccgacacctggtatattacagctctggtacatataggtcaaagtagcagtgataacacaacctaagatggagaacataactaagacagagttccatagaccaaccgtcagtttttgggtattagacacagaggatggcttatcgtagattggaaatggaaaatactcaggtttactataaagcacagctttcctcaaatcgacttggtaaacaatcaaattgactatcaaacagataaatggagctagtggccaaattgtagaaaacataacaagatacccgaattgtagaagaagctttttgaagttggcgtccaaatcaaatgttgctccccaggggtctgtttggtacgacttaacctttgaccaaattttcatatctgatgagctgagttgagctttaccgatttcactctcagctttgacaaagttaggatttggtccattaattttctgctgagcaatgctaacaaggcttggaacaaagttttccatgctaaattgaatcagttggttgataacaataaagtagaaaaattgatcttcatagcgctttgtatcaataataaaatctgaatcatgggtaggtaaacgggccaatattgaaaaggcattgaaaaccttagttcttatttctgcggtcaacaaatgccccattggcagataaagaaatagtgtaattaataggggaacgtaactggatagaaaaataataacaaagttcttagcttctttagatttctttgcattcacaacactgctatgattttcccactttgtcattggttctacgaaatatttgttgtaaatcacagttaaaaccggagtaaacgtgcaaataagtatagtaggcaaaaaagacaagatggaaatcattgggccgttataaatttgcttgtagaaaatttccaacgcaaaacaatatagctggaatgatagtaatattgcgccaaacaacaaagccacaggaataaaacaacatttcttcaacatgataaccgaactagcttttttttgggctttctgtttatcttgaagaaactcaatggtagaaaatgatgagtatttactcagtctatcagaccaaaatggttcatatttataaagccaaaaggctgtaaatgacaatgtccataggatggcgaacagcgagtatgtggaattgaattcatacgtaaaattagataaaaatctaattgataatccaaaaaaggagaagggaatcaaccattttatatagttctgtaagaatgcaaaatataaggattgtttgggattattggtcaaattcgataggttgtacaactcatactgttttggagcctccagtatttttgatttgctgatagaaatcagtttatgcaaatcatcggacaattcagtatcatgatatggtatgatggattcaatgaagtccagattctgcaaaaatgaaaaaagcggtttcgcattatcctgatggattctaataaacgcatagcttgtttgcagatcatggccaggttcgataatagaatgtatattcaaacgtttgaattcgacattcaaactcttctcgtttgcactcgaagttttattgaatacaataacacaattcggatctagagatgtaattgtctgcgacatagtatgctcaaccgcttgtgcttgttttaatctttttcaaatgtatttgacaaattagccataaatcgaccgaaacagtattcaccttcaaaaatgttaatgatggtgagaacggttattggagcgactgttcaaatatcttttccagccccctatttccagcttcccttatagaaataattgcaacggggaaaaaagggatatttcttaatgaagtcaataatagctgcaaaaagaaaactatttttcagttgaaaaatatggaaagtgcttatttatcagaaagcttttacagtctttcacactgatgtagtggtggaatctttttgttttgaaaacaacagagaaaaaaaaaagataaaaaaaagtgcccttgtttgttttcgtccctagaaggaaaaaaaaagagaagtttctcgcagagtgaaaaaaaatgtcaagaaaagatcctacaagaacaaattatgcgcaataatatgcttcgtgctgttttaggatcttggagtcagaaataaaatagttttgtaaatttatgtaagatgctgtagtcaaatttatgtatcgagtctatgcatatgtacaccgtgttgaggaatcttttctagaagcactgcggtgtcgcctcttgaatattttaacgcgattttttattccttggaacataaaatagacttttcatttgtatgatggttcatggaaattatagattagtacagcacaaacatgtcattgtgggtagataaatacagacctaagtccttgaatgctctttcacataatgaagagttgacaaattttctaaaatcgttatctgatcagcctcgtgatttacctcatcttttactgtatggaccaaatggtacaggtaagaaaacgcgttgtatggcattattggagtccatatttggacctggagtctatagattgaaaattgatgtcagacaatttgtcactgcttcgaacagaaaactagaactgaatgtggtcagctcgccataccatttagagatcacgccaagtgatatgggtaacaatgatagaattgtcatccaagaactattgaaagaagtggctcaaatggaacaagtggactttcaagattctaaggatggacttgcccatagatataagtgtgttattatcaacgaggcgaactcgttaacaaaagatgctcaagctgctttaagacgtaccatggaaaaatactccaaaaacattaggttgataatggtctgcgattcgatgtcgcctataattgctcctatcaaatcccgttgtctgttgattcgttgtcctgcaccaagcgatagcgaaatttcaactatcttgtctgatgtggtgacaaatgaaagaatacaactagaaacaaaggatattttaaaaagaattgctcaggcatcgaatggaaacttgcgagtctccctattaatgcttgaatctatggcactgaacaacgaattagcattgaaaagcagtagccctataataaaaccagattggattatagtgatccataaattaacgaggaaaatcgttaaagagagatctgtcaattctttaatcgaatgcagagctgtcctatacgatttactagctcattgtatacctgccaatatcatcttaaaggaactaacgttttctttgttggatgtggaaaccctgaataccacgaataaatcgtccataattgaatactcaagtgtttttgacgaaagattatcacttggaaacaaagcaatattccatttggaagggttcatagcaaaagttatgtgctgtctagattaatgtaagatatgtcataaatactgtataagtcacacaaaaagctgatatttaacgcatcttagtctttattttctttgttatttattttcatttaaaacaaactttactgttttttttttgtttattatttttagtatacaactatatagataatttacatttattcttcgtcattaaatttaggagccaagaaaaactgtaggaacccactcttcaaatcaaattggaataaagcaggagcttcgctggagagcctgataccaactctatcagaaagggaggagcccttaatgatgtccaataaatatttagctccgaacgtcaagtcgacaggttgatccatttcaagtttgatgcttgtttcaggatgttccatatccacgaatggttttattatgactgaacctgatccgatatcaccgtcagctacaaactttattgtttctttggtgatcatgatattaatagaatcactcaattgggacaagtcacgaacaattttagagaattcggaagatggcaatgacagggtggagtcgtactgtaattcttcaatctttaagaaatcagcatcgatatccatcaatttcagagagtattcggctatacggtctttcttggtatcctcaaataataagatgatggaatccggtgtgttgtcagcaattagtgttaatgtatcggtgttgttaccacaacgtaggattttacttagtgaggttagatccatacctaacgtaacaggatggtcacatctatattcttggaaggcttcgacacctatttccaaggagaccaatagaactcttgagtcatcgacagcttgtgcaatgataccatcttctttacattggaaattgaccaactggacacaatctttgaaaccatcaattattctcttgaaaagggatgcttcttcaaattttgcttctaacattttttctctcttttgactgcgtacttagtgcttgctgcttgttgctgtgagtgaaaaaggacggcgaaagtgaaaggtgcaagtggaaagaaaggaaggctaaagcaaaagtgtttcttatatataattttatgtaccagaggaagcaaagtacgaaaactatcagttgaaatccaaaaaaaaaaagttacgcgtttcgcgttttggtgcgtcggatggagaagaaaaatgctaaataattagatattgaagaatcagcataagttgtgcgaaaaaggaagagaatacataaaagaaaagaaggatatataagtaaaataatgataatagtaataataataacacataatgcaacctactcaacttctttctgaagtttcaaaagtacgttgtatgggaggtagagaacattgagttgttagatcaagcacgtgtagcattgtacaattccttttcagattcgtatctcttcttgtctgcttgagccttagattcatagggttgcttttcttcagcagttaaggccttccacctctcacccaatattctgcctacttggccaaaagttacgtcaggattctcggaacggacaatgtctctgttttcattagcaaagaacatataagctgacaaccgcctcttaggggcgttaggatccttctttctcctggtggtcctcttctttggttcctttggttgctttgcttctttagttgcggccatagcgctagttttatatatgttaatgttctaagttaattagttagtactcttgtcgtgcgctatgataaacaaaggaagggggtgcacagaacagcagtcctttagaggatactacagtagaaagctagagtcctgacttacaacttgagcatgccgttatgggcggctatttcatttcacctgaaccgtattaaaatatcatcttccttgctgctacaaccttcattgtagccggtttataagattaccatcattgtctacccctctttaacttctcccgaaaagcagagttgcccttagctgtatcctgttctagctgtgctaaactgtacgttcttattaagcccatcctcgtccgctgggctcacccagcgccttacatactttgcgaaaaagtcgtttttctgcttggtgttaggagctgtctcccatagtgtaaactcccagtattgcctcaacctcacttgctgtactttatagttgccgcgccacctaaaaaaaaaaacaaaaaagacaccacctaaaaaaacgggtgaggggaatgcacgtgacccaggtgcgggtaccatataaatgtacttctaaaattgtctacacagcttataatgctatatatgcaggttactattatatacaaacagcacagacagtcctcatatttacagctattttttggaatcatcagctatttctttggccacaaatcgcgaataatgtcgtagctgattctctggcccgaaacctcgtgtttgtacaaatcctccaatgaggcgattgctgtaatgcatctttgccacacatctgtctatgcagcattgctcacctttcgttagatcaggctcaccaaagccctcatgcggaatacatttctcaagacacgtactgagaatattgttgaaagtcgagcacatcgcatcgaattgcactcctgcaacgtctagcttctcttgcgagacctcctggttgccccttagactatttaaaaagaacgacatccttttcttggtgcactttaatattatacgggagctccgatatctatttcagcaatatagactacaatcaactttgctgttcttactttttagttaacttttttcttttcattctgccgctaatctacaaactcgttaccctactagtacataaaagaagatcagaatcgatgggtatttatttatatttgcaatattatttatttatacaatttattgttttaatagggtatcgttgtagtgagtagtattccagtcccagtagaaggtcaattcggtgacgttactgacactgctgacgttacagacctttaggaagtcagtaccagctactctcttttcagcatagtcgtagaaatcattgatttcacaagagaaccctgggccggtggaacaggtttcaattggaacgacagcatcgttaatgacgtatctgacgtaggtgtcgttagaacattggaatttttcggtgtagacacgagcaccttgaggaacgtaccaggacttatggaaggtgttgcccatgaatggaacgtattcggcagttaagttgtttttgtcgtcaattataccagcggtggtcaaatagtttaggatatcggtatcgtgggtaaaactcaaccagacttttaagtcttgagtttcactttgctttaacaacttcaaagtagcgttaaacaagttggcaccgacggatctgatcatatcataacctggtccatcctggtaaaacgataccaggtcctggccgtatgagtaacgtaccaattcatcttcggtgaagatatcacaaacatcactgtagcctctagcgttcaattcgtatgcacaccatgcaaacaaagtgttggcgtcctttgaggtcaaattcaaacccttgttttctttgtttaatctcttggcaatgtcatccaagtatgtggtatcgtatttgtccaaaatgtcatcgttagcatcttcatcccatcctgggcacgcattaccagcactcaaagtgtttgcgccggcggacatggcttcactgacagtctgcaaggagatgttgaattggtcacctaaaccatcaatgaaatattgagcagtgtcatgaaccctttcagaactagcggcgaaaattgggaaactggtttgattttcgaacatgtagccatattgcgctaaaaactcacgagcatgtctcttagcatccatctcaccagtgtatggattcaaaacattgtctgagttggcaaaagtggtttccatttccaaatcatcgtcatcacggatgaaaaactcgtaatcatcgttcaagaatgacaatgagccgttgaattgacgtgtgtaattgctcaacttataccatgttttcatgatggtagcacctttactgtaagttgggtatctttcaccatgtctggcaagcatttgcaattgtttcatttcacaaccttcaggcaagtcacgagaaataccatagtcgccagggaaagagaagtatggcccggcaccacccaggaatgggaatatgtcttcctgagtgccaattttggcaacatcggctaactctccgaggggaattgtacctgcattaactaaagcagcggctagaaccgaataaacaacagacttaaacataggtaatttggaatggccctttctttactgtagtattttttttatgataatcaaggcataattgacttccatccagcaaatttaagcacttatatatgttgcataggactactcaaagctgtttactatttcccaaactggtattatttagtaaatttcttttgaattttttttttttcactcttcctttttttcatttttgcgatgccagttctttgagtttcccttatacggcatatgcacttaaggtttgattttgctaattaaaggcgtgcctaagcggcgactaatactgtaatataatatgggttcctgactgactacagggattgaaacatccatttacctgtttcggatatctctgcagattttaatctttcggcaaaatttagataaaaaatttgggtattcgtatttagtttccaatattatttagttatacaaaactattgtctcaatagactggcgttgtaatgagtagtgttccagtcccagtagaaggtcaattcagtagagttactgacgctgctgacgttacagacctttaggaagtcagtaccggctactctcttttcagcatagtcgtagaagtcattgatttcacaagagaaccctggaccagtggaacaggtttcaattggaacaacagcatcgttaatgacgtatctgacgtaggtgtcgttagaacattggaatttttcggtgtagacacgagcaccttgaggaacgtaccaggatctgtggaaagtgttgcccatgaatggaacgtattcggcagttaagttgtttttgtcgtcaattataccagcggtggtcaaaaagtttaggatatcggtatcgtgggtaaaactcaaccaaaccttttggtcttgaatctcactttgctttaataatttgactgaggcattgaacaagttggaaccgacagacttgataatgtcgtaacctggaccctcatggtaataagtgtgcaagtcttggtagtaggagtaatggactaattcatccttggtgaaaatatcacagacatcactgtaacctttagcgttcacttcaaatgcacaccacgagaataaagtactagcgtcagttgaggtcaagttcaaacccttgttttccttgttcaatctcttggcaatgtcatccaagtaggttgtgtcgtattcatttacaatgtcatcattggcatcgtagtcccaagcaggacatgagttacaagcactcaaagtgttggcaccagcggattcagcttcactgacagtctgcaaggtgatgttgaattggtcacctaaaccatcaatgaaatattgagcagtgtcatgacatctcttagaattagaggtaaaaacggcgaaactggtttggttttcgaccatgtaaccgtattgagccaagaagtcacgagcatgtctcttggcgttcatttcaccagtgtatgggttcaaaacatcgtccgagttggcaaaagtggtttccatttccaaatcatcgtcatcacggatgaaaaactcgtaatcatcgttcaagaatgacaatgagccgttgaattgacgagtgtaattgctcaacttataccatgtactcttgatagtcttagccagactgacagtagggtatctttcaccatgtctaccaaccatttgcagttgcttcatttcacaaccttcaggcaaatcacgagaaataccatagtcgccagggaaagagtagtatggtccggcaccacccaaaaatgggaagatatctttttgggtaccaatcttgtcgacatcggctagtttgcctaagggaatggtacctgcattggccaaagaagcggctaaaattgaataaacaacagatttaaacattggtaatctcgaatttgcttgctctatttgttgttgttcttattctcatgagagatgaagccatactaacctcgacttagcaaaacatcagcgcttatatacgtttcatttcgacaattcaaagatgtttacccttatcccaaatgggtatatgccttgccaagtaaggtgaccaatttgataatttggcatgtgcgatctcttcgaaaacagggaccagaatcataaatttagtctgtgctagtcccacgtgtgagtgccaaggttgtatcgattcatttagagattgcctattcaattaactcttttaatcacttttactttttttggcattgtgcagttgcgttctatgcgaaaacgtgctaatttaatatatatttctttgtgcagacaaagaaaaagcgctatgaaccttttaccttcgtttgaagtttatagacgacgtccgcttacatgagaaaacattaaagcagcgcacataagatgacttccaaatacgttgacatatttgcgcattcttgttgaatacaactttcggatccttgtaatgccggtctccggcgtcctgtaaagagagcgtgcgacacgccgctattagcgtggggactgacatcaggtcaacattattattgtagcgagctactttcggtcagtaaatagaacatatgtagagatacaagcgattattagaaggagcggacctacaacaaagttgggtcacgtttctcgcaattattacttggatgccctcctagctaatgccaatgtgcagtagtaacttatcagtccgatgtgtaaaaaatagaactaattttttgcgaaaagatggacaaaaaccatctctggtcaattttctcactaaagagggacggagtctcttgttttcttctattagtgcacagggaatgttttgattttccctttttttttctttcgcttcttcaacagtggtaaaaataaaaattattggcgatgggataaccaaggaacattgtatttagcaattgaaaattacggtaaaggcagccgctctgacttgatctctgacattaaaaattcggaaacaataaatatttcttttaagatgcgggttttaataactaacgatgatggtcccttaagtgatcagttttcaccatacattagaccttttattcagcacattaaaagaaattatcctgaatggaaaatcacggtttgtgtacctcatgtccagaaatcatgggtgggtaaggctcatcttgctggtaaaaatttgacagctcaattcatatattctaaagttgacgctgaagacaatactttttggggcccatttatccagccacaaattaggtcagaaaactctaaattaccttatgttctcaatgctgaaattccgaaagatacaattgagtggatattaatcgatggaactccagcatcgtgcgcaaatatcgggctgcacctattgtctaatgaaccgtttgatctagtactgtcgggtccaaatgttggtagaaatacatctgctgcttatattacctcttctggtaccgtaggaggcgcaatggaatctgttattactggaaatacaaaggccattgctatttcttgggcctattttaatggattgaaaaacgtctccccacttttaatggagaaggcctctaagagatctttagatgttatcaaacatcttgttaagaattgggacccaaaaacagatctatatagtatcaatattcctttagtggagagtttaagtgatgatacaaaggtttactatgcaccaatttgggaaaatagatggattccaatattcaacggccctcacattaacctagagaatagctttgctgagatcgaagacggtaatgaatcatcatcgatttcctttaattgggctccaaaatttggggcacataaggattctattcactatatggacgaatacaaggacaggactgttttaactgatgctgaagttattgaatccgaaatgatcagtgtcactcccatgaaagccactttcaagggtgtgaaccaccttcttggagagttgaaactgactgaggaagaaaataatttatcaaaaacaaataacctcatcgtggtaagtatagacccaatggaatatatatacaaacctctaacccacgccctgaaaaaatatctgccacaagtggagattgtatcaaacttgccagaatttgacaatggagggtgtgaaaaagaaatgaaggtttttcattacggtgattacgaacagctagatatggacaaactaatggaactgcccaataattacttcacaaactcttatatatataggaaggcattgataagaaaacactttctttcgcataccatacagacttatactgcgaagaacccagagtccattttaaagaaggcatatttggaatcattcactattgatttagattatcgtgaatttctagacgacgcattagatgaaaattgggaattacgccaagagttggagaatgaaagccaagataaatggtggatcgtgaaaccgagtatgagcgataaaggtcaaggtatcagggtatttaagactattgaagatttacaggctattttcgattcctttgacgatgaagacagcgaagcagaagagagtggaaatgacgacgatgctgatgatgtaaatggcgaattcatggataataacaaggttaacatttcccaattgcgccactttattatacaagaatatttaaccaatccgttactattggcatctatggataatagaaagttccacataagatgttacgtcgtctgtaggggagatttgcaagtttttgtttatgatagaatgctagcgctctttgctgccaagccatttgttcctctagatccatatgcgtattccgtaactgatttgaaagatttggaatgccacttgactaacacatgtctgcagagcaaaaagaaggataaagattcttctgttttggagtttgactccatagaggaaattccaaatgagagaaagtccaatattaaggagcaaatccatagcataacgaacgacgttttcttagctgctgtaaatgtaaatagattaaacttccaaccgttaccaaacgcatttgaaacatatggcgtagactttttgattgattcgaattacgaagttaaattactagagatcaacgctttcccagacttcaaacaaactgggaaagatttgaagaacctcattgatgaattatttgatgacactgtcaaatactgtgttacccccatctttaacgagaatagaaataagacagatgatgaaacagacccgaacttcgtaaaagtcattgattacacttcaaacggttggtgaaacaaaaaaaaaaaaagaacccatcctaaaatactgttattattactaaatagtgctaaataatacatatgccttgattttatttccgaaattttttgttttgtcaatttaggctctattagcttcttcatcaggttcattatcgtctacaacaccgtcttccatggtattttcaatttcttcctcaaaatttgttgtcttatttgttgtagcactgatcagacctctcttcacaacacgtagagccaccgggatagtaatatcatcgtcagatatacccaaatattcccgactccaatttaaaatcctacctcttattctattggcttttattacagactttctgattttttgtaagtttcttatgaattctttattcctctgtagtgcaatctgcgacagctgtcgggcagactcaatttcctcatttaactgttgttgttcggccgctgttaatgttgatatagaagcagaaccggaagaagatggcagcaacgataacagcgcattagattgttccaaccttggcaatgcaaaaaaaggatcttcctctccaaattcttccatgccattattgatatgaccagcttcagtagacaaactattcgagttaacctcgttgatattgtttttgttgttaatgtcatcctcgtcgcttgcccctctatcctctggaagggtcaaattgtgattataagatggtaggttcaagttagattcataaattggttcaggatgatctcctaaaaaaacctccaaaaactgggaatatctaacaactgacatctgttctttttcaatcattagaattatttgcaaggctaaatttttcaaaattgggcttgaaaatgtccttgagatagttttatgatttattatatcccctagggaaagaatgggagtcaaaatctcctttacattcactagttttgataggtcgtcatcgtcttcttcgccgtaatactcatcagtgatattttcgtcttccttctcactaccatcgatgtcgttttcatcaccgactaaaacaggctcgacgttgatgtcaggtgtgaattttattcttttgcgtctactatcagtgacaatatttgtttgcagaaggcgatgctccgaaccgttatagaacacagtttgctcaatcattggcttagaattgttcaagtctcttcttgttactacttcgcttctctgcaaaagtttgttacctctgttagaggatatgccagtggcctcaggatagattagttttccatcaagggatcttttcagtacctgatagttaccgcttttttcctttattatccttctagtaaatgtgctaattatattcgattcattagctaacacactcttgctttccaattctgcgttgtttttcatactgctcctaatagtcatctcgatcaacaagaagcaacagctgagatatttgtttctcaacctcttttttgcaggagatgctgtcatcaagcaacgtttcttctatttgaaagcgattgttttaccagaacaaagttcgctacccggcttcggtcctcttgggtataggagacaataatgatcttcgaataacgccgttataaagtgaacattataattatccgcttaaaggctttttagtaattttgtaaaacaattgcttctaatttcaagacttccaaaaggtttctcgagtaactagtgctttccaatatctacaacaaaataaaataatagaataatgggtgtttgcactatttttaggtggctctttgctgcttacttgctctcttcatataagtcgcttcctggggcatattttgttaggttttattattatgttattcaaaacttgttcttgcctatgtttacagggtttgaaaccgagaatattaagaaacttgagaaaaatgaatatggctgtttctcgtacaccagcctagatacctatgcctctccattcgaatgtgacttctactttcataagagcaatagcacctattttgcggaattggacatttcaagaggtaatctcatgtgcaagatttttcaaaaattgatgctgaattccaagcattatccatatattccagttgcgaacgttttcactaatttcttgaaggaaatcaagccttttcaaaagtactcggtttcatcaaggattatctgttgggatgagaaatggatttacgtcatgagtagattcacaattaaaaagggcaccgtcttatgctcattatcattgaccaaatacgtccttaaggacggtagaaagaccatcaaaccaaaggatgctcttgaatactgtggtttatataatgagaaggtcgccaaaatttctgaggacaatctaaagcttttaaccgagcgttgtggtttccacgagacagtaccattggaaaacttgagccaagagtactgttcagaaatctaacttctatacacatatagccggtattataaaatatataaatctatcttctttcaaaagtttctctgtgcagtctgcgttatattttatcttcggtagaaaacaaggtaaatttcccttatttttcaacatcataaaaatgaaaaacagatatatcttaagtaagatacttaagcagacaagttgaattggagaaatacaaaagctgtaaggttatcaaaaaggaaggcatacagtataatgggggcacaattatcactagtggtccaagcatcaccttccatagccattttttcatatatcgatgtcttagaggaagtacactacgtttcacagttaaactcatcaagattcttaaaaacatgcaaggcactggaccctaacggcgaaattgttatcaaagtgtttattaaaccaaaagaccaatatagcttacgaccttttctccaacgtataagggctcaatcgtttaagttgggacaactaccgcacgttttaaactacagtaaattgatcgagacaaatagagccggctacatgatacggcagcacttaaaaaataatttatatgacagattgagtttgagaccttacttacaagacattgaactgaaattcattgctttccagttgttaaatacattaaaggacattcataatctgaatattgtccatggtgatataaagacagaaaatatcctagtaacaagttggaattggtgtatattgacagattttgctgcatttatcaaacccgtatatttgcctgaagataatccaggtgaatttttattctacttcgacacctcgaagagaagaacctgttatctagccccggagaggtttaactctaaactttaccaagatggaaaatctaacaatggtaggctaactaaagaaatggacatatttagtcttggatgtgttattgcagaaatatttgctgaaggaagacccatcttcaacttatcacagctattcaaatataaaagtaattcatatgacgtaaacagggaatttctcatggaggaaatgaattctaccgatttaaggaacttggttctagacatgattcaactagatccatccaaaagactttcatgtgatgaactactgaataaatatcgtggcattttcttccccgattatttctacactttcatttatgattatttcagaaatttggttactatgacaacaagcacaccgatatcagataacacttgcaccaatagtaccttggaagacaatgtaaaacttttagatgaaactacggaaaaaatatacagagatttttcccaaatatgtcattgtttggactttcctttaataaaagacgggggtgagattggttcagaccccccaattttggaatcttacaaaatagagatagaaattagtcggtttttaaacacaaacttatatttcccccaaaattaccatttagtcttacagcagtttaccaaagtatccgaaaagataaaatcagttaaagaggaatgtgccttactctttatctcttatttgtctcatagtataagaagtattgtttcgactgctacgaaacttaaaaatttagaactattagcagtatttgcacaattcgtttctgatgaaaataaaattgatcgagtcgtaccttatttcgtatgttgttttgaagatagtgaccaggacgtccaggccctatctttgttaacattaatccaggtactcacctctgtaagaaaattgaatcaattgaacgagaatatatttgtggactacttacttccgagactgaaaagattacttatttccaataggcagaataccaattatttaaggattgtgtttgctaattgtttgagcgacttggccattatcattaatagatttcaagaatttacatttgctcagcactgcaatgataactcaatggataacaacacggaaatcatggaaagcagtaccaagtattcagcaaaattgatccaaagtgtcgaagatttaactgtctcttttttaacagataatgatacttatgtaaagatggcacttttgcaaaacattcttccactttgtaaattttttggtagggaaagaacaaacgatattatactgagtcatttaataacctaccttaatgataaggacccagcattgcgagtttccttaattcaaacaatatccggaatatcaattcttttgggtaccgttacattagaacagtatattttaccattgttaatccagaccatcactgattcggaagaattagtagtgatcagtgttttacaaagcttaaaatctttgttcaagactgggttgattaggaaaaaatattatattgatatatcaaaaacaacatctcccttgttgttgcatcctaataattggataagacagtttactttgatgataattatagaaattattaataagttatcaaaagccgaagtgtactgcattctctatccaataataaggcctttcttcgaatttgacgttgagttcaacttcaaatcaatgataagctgttgcaagcaaccagtgtcaagatcggtttacaatctattgtgtagttggtctgttagagcgtcaaaatctttattttggaaaaaaatcatcacaaatcatgtagattcattcggaaataatagaatcgaatttataacaaaaaattactcaagtaaaaattatggatttaataaaagagatacgaaatcaagttcctcgctgaagggtattaaaacatcatccaccgtctattcacatgacaacaaggaaattcccttaactgctgaagacataaattggattgataagttccacattattgggctaacagaaaaagatatttggaaaattgtggctttgaggggttatgtaataaggacagcgagagttatggcagcgaaccctgattttccatataataatagtaattaccgtccattagtacagaactcaccacctaacctaaaccttacgaatattatgccaagaaacattttctttgatgtagagtttgctgaagagtcgacaagtgagggacaagattctaacttagagaaccaacagatatataaatatgatgaaagtgagaaagatagcaataagctaaatattaacggtagcaaacagctatctaccgtcatggacataaatggatcactaatattcaaaaataagtccattgccactactacttctaatttgaagaacgtttttgttcagttagaaccaacgtcctatcacatgcattctccaaatcatggcttgaaagataatgcaaatgttaaaccagaaaggaaggtagtcgtcagcaacagctatgaaggcgacgttgaaagcatagaaaaattcctatcgactttcaaaattttacctcctctgagagattataaggagtttgggcctattcaagagattgtacggagtccaaacatgggtaatttgaggggcaagttgatagctactttgatggaaaacgaacccaattctattacgtcttctgctgtttctccaggagaaacaccctatttaataacaggttcagatcaaggtgtaatcaagatttggaacctgaaagagattatcgtgggcgaggtttactcttcttctttaacttatgactgctcctctaccgtaactcagataaccatgattcctaactttgacgcgtttgccgtttccagtaaagatggacaaataattgtattaaaggttaatcattaccaacaagaaagtgaagtcaaatttttgaattgcgaatgcatcaggaaaattaacttgaagaattttggtaaaaatgaatacgcagtgagaatgagagcatttgtgaatgaggaaaaatctctactagtagcattgacgaatttgtcaagggttattatatttgatattagaaccctggagaggttacaaattatagagaattctccaaggcatggtgccgtttcaagcatctgtatcgatgaagagtgttgtgtcctaattttggggacgactagaggtattattgatatatgggatatccgtttcaacgtgctgataaggagttggtcctttggggaccacgcaccaatcacgcatgtggaggtttgtcagttttatggaaagaattctgtaattgttgtaggaggtagttcaaaaacatttctaacaatatggaattttgttaaggggcattgtcagtatgctttcataaattctgatgaacagccatctatggagcactttttaccaattgagaaaggcttagaagaattaaatttttgtggaatcaggtctttaaacgcactaagcactatctcagtatctaatgataaaattcttcttaccgatgaagcaacaagttccattgttatgtttagcctaaatgagctttcttcttctaaagcagtaataagtccttcaagattcagtgacgtttttattcctacacaagttacggcaaatctcacaatgttattgagaaaaatgaaacgtactagcactcattcagtagatgattctctatatcatcatgatattataaattctatatctacatgtgaagttgatgagacacctttgctggttgcttgtgataactcagggcttattggaatcttccaataattttttttattttattcagcttctttattctaaatgcgtataaatttgtattcaccttaaacattttcgatcatttaggaaagggcttgcaacgcgttgaagtacccttttcacgaaaaaaatggttgtatacgtaaataaagaacaatgtatggattatggtatagaataatagtagtcacatattgcagctagttaaatgagccagatcgttgattttgttgaggacaaagattcaagaaacgatgccagtattcagatcatcgatggaccctcaaatgttgaaattatcgctctctcggaatcaatggatcaagatgagtgcaaaagggcacatgtaagctctgcagagatgattccatcatcaccgcaaagaaaatctgtttcgaatgatgttgagaatgttgacctaaacaaatctatcgaactttctgcgccgttcttccaagatatcagtataagcaagctagatgacttttctacaacagtaaattccatcatagattcgtctctcagaaatgagaataatgcaaaaggaaacgcgaaaaaacttttggatgatctaataagtgatgaatggtcagctgatcttgagtcgagtggaaagaagcacaacaaatcacaatacaatttgagggacatcgcagagaaatggggagtacagtctttaaaaaatccagagcctattgctgttgactgcgaatataagacacaaggaatcggaaaaaccaatagtgacattagtgatagtccgaaatcacagataggagcagctgatatactgttcgattttccactgtctccagtaaaacatgagaacccaactgaagaaaagcacaattcgattgctaatgaaaattcttcaccagataatagcctgaaaccagcaggaaaacaaaatcatggtgaagatgggacatccatggcaaaaagggtatacaataaaggtgaagacgagcaagaacaccttccgaaaggaaagaagagaaccatagcgttatcaagaacactaatcaacagcaccaaactacctgatacagtagaactaaatctttctaaatttctcgattcctcagatagtattactactgatgtactttcaacccctgcaaaggggtctaacatagtaaggacaggtagtcaaccaatctttagcaacgctaattgttttcaggaagcaaaacgctcgaaaacattaacggctgaggatcccaaatgtactaaaaatactgccagagaggtatcacaactagagaattatattgcctatgggcaatactatactagagaagactcaaaaaacaaaatacgacacttgttaaaagaaaacaaaaatgcttttaagcgagttaaccagatatatcgagataatataaaagcacgctctcaaatgattatagagttttcgcctagccttctccagttatttaaaaaaggagacagtgatctgcaacaacaattggcaccagcagttgtgcaatcaagctataacgattctatgccgcttttaagatttcttcgaaaatgtgacagtatttacgactttagtaacgatttctattacccctgtgatcccaaaatagttgaagaaaaccgttttgattctatattatgatgcgcaagaattttttgaacaatacacttcacaaaagaaagaattatataggaagatacgatttttctcaaagaatggaaaacatgtgattcttatactaagcgatataaataaactcaaaagagctattttccaattagaaaatgaaaagtacaaagctagggtagaacaacgattgtcaggaacagaagaagctttaagaccgagaagtaaaaaatcaagccaagttggaaaattagggataaaaaaatttgatttagagcaacgattgcgcttcattgatagagaatggcatgtcaaaatacatactgtaaattcacatatggagtttattaattctctgccgaacctagtgtcattaattggaaaacagcgcatggatcccgcaattcggtatatgaaatatgctcatttgaatgtaaaatccgctcaggatagtacagaaacgctaaagaaaacctttcatcagatagggagaatgcctgaaatgaaggcgaataatgtcgtgagcctataccccagttttcaatcattacttgaagatattgaaaagggaagactgcaatcagacaacgaaggtaaatacttgatgactgaggcagtagaaaaaagattgtacaaactgtttacttgtactgatccaaatgatactattgaatgatgatcgaacgaaactttgtatataagaacataccttaaggcagtcgttttgaaaatcactgcagctctatttccccctccttacctttttaatgaattccattttacagaaagtactattgataaatattcgtaataaaataaaacagtgttaataataaatgttcgagattccggttaaagataatatgaaatggtgaatgtaatatcattttatttctacggacgtaatcataatacatactttacggctaaataatcgtcttcattaagtctgtcctttagaggctcgatatgtttgtaaccttcgttcaatttgtgcaattcctgttcattaaattttattccggaagatatcaggtgagagagaaaagacagaactctatctatgatgttcaagttactctcgtcagacaagcactcaatcgtactttcaattactccatcctttctcagcacactgattatattttcatcaatcttaacagatgacaaatatgcggtcaataaggcaatggctctcattttcagttttggtttggcggtgttatcacttaatacaggtgctatgcagtcgagcccatttaatttgaaaaacttttctgagatatctttgtggtttcttattagattagatagtgcgtaaaaagcttttgttctcacgtcgagtggctttgtcttgtcactagctatttcgataaggcttcgcagaccattgtcgtatttcatgaaattattttgcgaatccaagttgttttgcacagccgttccaataatggataaagcagcagcacgtagttcttcatccttcgtctgaacaagaacatccaacaatggctcccacagttttaaattttcgatattattagcattatctaagttctcaatcaacatttcaaagttgtcaaatgcaacgagttttgtttctaagtcaacctccggattcataataacagccatggattctttcattaaggttggatcgtcaggaccaccaccaccgaataactgctgtagcaatttaggatcaggttggccggccctagccatagcttctttgtccccttgagaattcgcaatagaccactgtaatagcttttccatagttatgtatgtgtttttttttctattttactctttcgttgaaaggtaatggctttctgactgacgatgagtgctcttttagatatagccaatcgctggtttataagcaaatttctgtcagcgcgagatgccttcctcttttctaacctccaaaaaacttccagaagattccagtccaagaggtatatcatttcaaacgaataagctgattacaaccttaatagggcccaacttgaccaaccagtagctgaaaagcttacctacaaaataggaaataggttagtacactgtcgacagcagtggtataagtatataccctacctacacatcatatatattgaagtgaggtttattttctgtgatcttgtttagcgaattttatcactgttctttttgataaactcgtccaatttgtagacaaaatccaaacctacggccttcaatccatctatctgttttctggatgacttaatggaccctggggataacatttcatcattcagtaattgcttgtctatcaatttgaagtgattatccacttcgtcgctacaccaatctactaggatggaagaaatcttagccccgagttctttgaaaatatcctggaagtcctccactgtttttttaatggtttggaacctgataacagccaattgagtcaaatagttcgtaggattgtccactgatccaatctgtagaatcaaatcttgaatgaaattagatctattctgtaagaataggtcaagagcttgctctggtaatcctaacttaatcatattttcagtaccgcttttcaaatgcactatttcattcgatgataaaatgctctgagaaagtttgctagaaatggcctctcttctttgttcgatttttaaagatatcaggttaagtaacattaactcttcatcagaaattctttcagaaagatcctccaattgtgattcaatatccaataatgtttccacggcactttcaaacctaagcctagctaattcaatatctatctcttccacgccttcatccaggaatttaagcctctgggcggttgaactcatatctctggaccttggcctcgaatgcattgatagagttaggttctgcaaaagatattgatccattgcgcctgttacatttcggccaggagtgattgaaccccccatactacgtcttttgtttttgttagggcttctgttgttttctctacctggggtttgttgcgtagattgcaaatatctaaaggactctctaatacgtttagagttctcctcttctacatggaatatgtcgcacaaatcatccttagcctttcttataacgtccaacaacctagagcattcgtctgcgtctctacattcatacaaacttgaattcgaattgctaaacttgaaaagtagcctcttagtggaaaattcctcttgcgtgacagtgacatcctttaaaggatagcactggcttactataaagtcattttgcttatctcttgatttatcggcgataagtaccaaatcattcaaaatgaaaatctgtaccatctgcaagggtttaccagtggtagtatttaattccatccaattggcactattcattaaaatatgtcttcctttcgtagaattgataaacttctgagcaccttcaacgttcttaaacagctgatccagttccgtatcccaaaatttctctaatatcaagacgctcgatctgtccctcctcatgagattcccattttgtcctgctttcaaaggcggaagtaacgctggactattagaatgactttcaacattgttaaaattgccttgtctctcttgatctatttgatcctgcaattgtaaccttttttcagctattttggtgcactgatccaaaacctcgtttaaatcatttatatttgctctaacccttttaagctccaacatagcaacatttaggtcgttgtttaccgtcatgatttcgttatatgatttattgatatttaactttacttcttcttggacctgtatcgataaatctgttaaatttgaggtaaatttatcaatagtaatggcactcgcattgcctagtttatcatgaacaaaatctttagcattaaaatgcgggtttgccaacatctttcttagcgacgtgctattattgaaaggatcattactgccggaaggattgacagtatttcgcattgctgatctagcaggcaccttattataggagctgtcgttcagggagagatcggcagttgaaagatttaaactgttggaagggcctttagagcttaccgattcgttctcagtggtgaaactactattattatgactactatccacattatcattgggaactatcatgtttggcatatcaggtaggggcattgagtaatctagtgtaggtggagcataatttgtattatgaattgatagtcttctctgcattgaagttgctaccctacttctctcccttgcattgattgttggtagcgtataactggtagccggatccttgagatcactataagggttcttttttgttttttgtttaggcttagcaggcgatggaggtgtcttttgcttagcaggagagcttgcagacttctttacatgcttccaattgtttctggccttcttcaaagaaaactcaaccattttcacagtacaaatatttcaactttcagtctcttacctggtctaatatgaaggctttttgttcattcggctttgctcaaggtcttacaaatatactattaactgcagtctctagtctctttttccagtcatctattttcatggagcggaacttagcaaacgagaaataaacaaaaatgattaggaatgtattcatgttgaaaaggttatgagatatcgaagaccattcgttttgatttgcaattagtgagaacaatttaaacaccttggtgcgaaattgaaggtttttttttccaaagaagtgtacagcccacactaacaactgctaactcagataaaaataacagaaacaaaaaaaaggtagggaaggcccatcacacggaaaatgagtataacaagtgaagaactaaactacttgatatggaggtattgtcaagagatgggacacgaggtgagtgcattagcattgcaggatgaaacaagagtattggaatttgatgagaagtataaagaacacattcctttgggtacactggtgaatctagtacaaaggggaatcttgtatacagaaagtgagttaatggttgatagtaaaggtgatatcagcgctttaaatgaacatcatctttctgaagatttcaatttggttcaggcgctgcaaatagataaagaaaaatttcctgagatctcttctgaaggaaggttcactttggaaaccaattccgagagtaataaagcaggtgaagatggcgctagtactgttgaaagagaaacccaagaggacgatactaattctattgacagtagtgatgacctagacggatttgtcaaaatactgaaggagatagtaaaattagataatattgtttcctccacttggaatccattggatgaatctatactcgcatacggtgaaaaaaattctgttgcaagactagcgaggatagtagaaaccgatcaagaagggaaaaaatactggaaactcacgataatagcggagttgagacatccttttgctctgagtgcaagtagtggtaaaacgacgaatcaagtcacatgtcttgcttggtcacacgatggtaattcaattgtcacgggtgtagaaaatggtgagctaagactatggaataagacgggggcacttctgaatgttttaaattttcatagagcacctatagtatccgttaaatggaacaaagatggaacacatatcatatccatggacgtggaaaatgtcactatactctggaatgttataagcgggaccgtcatgcagcactttgaattaaaagaaaccggtggctcatccatcaacgcagagaaccatagtggcgatggttcacttggggttgacgttgaatgggtagacgatgacaaatttgtcattcctggccctaaaggtgctatatttgtataccaaattacagaaaaaacgcccactggtaaacttattggacaccatggacctatcagcgttttggagttcaatgacaccaataaacttctacttagtgcctcagacgatggtactctaagaatatggcatggcggtaacggcaattctcagaattgcttctacggacactcacaaagcatagtatcggcatcatgggtcggtgatgataaggtaatatcctgctcgatggatggctccgttcgcctatggtcgctgaagcagaatacgctattggctctatcaatcgtggatggtgtcccaatttttgctggaagaatatcacaagatggacagaagtacgcagttgctttcatggatgggcaggtaaacgtctacgatttaaaaaaactgaacagcaagtcacgaagtctttatggtaaccgtgatgggattttgaatccattaccaattcccctctacgctagctaccaaagcagccaagacaatgattatatatttgatctgtcatggaactgtgcgggaaacaagatttctgtagcatactcgcttcaagaaggttcagttgtagccatataataactaggtacagtacataaacagatgaattttatcattcttattgttatttctttgtttacaaaaggtgaaaagtgaaaaatttcgcaatggaaaacgtcgcgggccgcctttgagtgacgttgtgcaggaatctcgaagagtcatcactttgaagataacggccgctcgcgatgagagaagacaatgagcattgcttttttataattttttataccttgtgttaaaataagtttctttaattagttttcacctcttggatgatacaactgtaattgataaataggggtagccataaagaacagaaaaaagcggcgcaataatttcgtgtattacaattacagttagtcatgagtgaagaatttcctacgccgcagcttttggatgaattggaagatcaacagaaagttaccacgccgaatgagaagagagagttaagttctaatcgtgtgttgaaggatatttttgcgggtaccatcggtggtattgcacaagttcttgtagggcaaccgtttgatacaacaaaagttaggcttcaaacagccaccacaagaacaacaacgttggaggtattgcgtaacttggtaaagaatgagggtgtgtttgcattctacaaaggtgcgttaacaccgttattgggtgttggtatatgtgtctcagtacaatttggtgtgaatgaggcgatgaaaagatttttccaaaattacaacgcttctaagaacccgaatatgagctcacaggacgtagatctttcacgttcaaatactctgccactatcccagtactacgtttgtgggttgacaggtggtgtagtcaattcattcttggcatcgcccattgaacaaataagaattcgtttgcagacgcaaacatctaatggtggagacagagaattcaaaggtccttgggactgtattaaaaaattgaaagctcaaggtggattgatgaggggtttatttcccacaatgataagagccggacatgggcttggtacatattttcttgtctacgaagcattggttgccagagaaattggtacgggactaacaagaaacgaaattcctccttggaaattatgcttatttggtgcattttccgggacaatgttgtggttgacagtatacccattggacgttgtgaaatccattatacaaaacgatgatttacgaaaacctaaatacaagaattccatttcttacgtagcaaagaccatttatgcaaaagaaggtatcagagcctttttcaaagggtttgggccaacaatggttaggtccgcgcccgttaatggtgcgacattcctgacgtttgaattagtcatgagatttctgggggaagagtaggagagtatatatgaaaacatcgttttatagatatagacatagacatgctgttatcataccaaatagaaaagtgtacagtcttttagtgattatcatctatgtggtgtcaaactaagaaattatatcgatcgttacagaatatatgatgagggaatatgcataaaaaaaaatctaaagttagtgaagagaaaagggtatgcaggtaaaaacgaatatatcacacatcaagcaaactcaaaagaacaatcactggactcgactttatttttcaaagatggtactaattccagctgttggaacttttcagcatcttgatgatagtaaaacccttgaatgttcccggtaacttgatcatggacaatgtaataaaacccatcataagatgcgccgtctacaccttccattaatagggcatctggtaccaaaaatttttccttccatttcataaatataaaccgttcgttcaagtagttgtcaaattgtttctcttggctaaaaattcttgatatgttaccagcgtctgcgcttggtgtagtaggaagctgctgtggaggcaacttcttggctgcatttgtagtgccattgtcgtcagttgagttgagaccgtttttttggctcatcaggaaaagctgtctaaaggaggggaaatttatccagtgttctaagtctgtttggtctgtggctttgaattcgtttaaaacaggttcatctttccagctagaggacaagaaccctaattccttgtggtttaccgcgtaggcttcaaaatatgtactgatttccgggtgttggttcgtgagtcctcttatcgacaaaaatccagataaatgaggggacagcgacgtgcaatctttctttggcaaatctacagtctttaagttaactgttacctgatagcgtttgtatcctgatatctggtaccctgtaaactgcattcttggtcttaagtagtttgtgcaaaccgtatggttataggaagaggtcacaatgactggattttccgaactatagggagattggtcctcaacaatatatttcttccttgtcgacccattaggtgtatgggcgagttgctgcagggaagacaacgaatccctagaagcgcacttgtaaagatcttgctcttgtaagtagcgatgacggtcatgaagatgaaagggtgcggttgaagtcaagttgaacgtgatcggatactgatttctagaaacagggggggctggtgttggttctggcgaagccgcttgctccgactgctttgatgtcacagctttgggtttctccgctacactgtctaccttaggattattgatcatgactcaagcttgcgatatgtgttggtgtcatgcacaagacgccacaaatgatagaacagaaaagaaagtgaactaatcttccaagacgaagaaaaccaaaatccgggatgagttgaaagtcaaaaagactgtatatataaatttcaacttttgtagaagatgcagaaaaagaaaatgatatggtatgcagaaaaagaaataaaccgctattatcctcgcggtttgtcattataacaggcaattacactagagaaagccgcacacctccctccgtttcttttgccctgcgagtttttccggaaaagaaaaaaaaaacgaaaattaaaacccgcctgccccgcggggtgggggaggggtcaccggaacaaatcggataatccctcgcctgccttagatatcgttctgaacggctgaaattatgaaagaagaagaacatcactttacacggatcgcacgcccataattcttttttttttttttttcatatcttcgacgtttgccactgccttctctttttctttcttttttggcggccggtggccaaacgcgccaaaaccgaaacgcttataaaatgtagttgccttgctctttcattcgatatacatataagaacgctcactgttatcttacattagaagctagaaactataacagtataacacagcacaagagaaccgagcagcccgccatgaatcctcaagtcagtaacatcatcatcatgttggtcatgatgcaactctcccgtcgcattgacatggaggacccaaccatcatcatgtacattagaattttatactgttcttccatcggtatctcttggatcatctaccaaatggccagaaagagaattgttgctaaaaacgacatgactaccatgaagtacgtcgaacctggtaatgctatgtccggcgaaggtgagaagctgcaagttactaccgtcagagactacgatttgaaggaaatagacagtgctatcaagtctatctacactggtatggctatgatgggtttcatgcatttgtacttgaaatacaccaacccattgttcatgcaatccatttctccagtgaaaagcgctttggaacacaacgaagtgaaaattcacctcttcggtaagcctgcaaccggcgatttgaagagaccattcaaggctccatctttgtttggtggtatgggtcaaactggtccaaagaccgacaagaaatctatcgaagaagctgaaagagccggtaacgctggtgttaaggctgaatgattcgatcaaaagcgaagtatttttttttcctagtttttatgtaaaaatatattcatttttttctctacgcagttgctgcagtgttataagaaaaatagaatgaaataagataaagctagacgaattgtgtctattttcctacatcgccatagaattgctttttttttcttgattagatgaaatgaaaacaaggaactctatttgttttcattttgttgggcttatcatgtaaagaaaaatgagtcgtgtcctctttttcctcgtgcttgtatgactgccgcactttccgctaagtgcgctcgtctatatgattttatgcaaatatatactgaaagttcaacaaaattaaactatgtgaacattagttcatagcagccattggcccgttgtgtcgggatctctacactaaattgtaatgtctctgggattttgtggggtgtcattgcagatatgacgaaccggatattactgataatgacgatgattcatgaaggtcttcaggttcatatgtacaaaaaaggtagagctgtggttttttattgtatcttggtgaatattctttatagtgttactcgctggtaaactgaatcgattggagtacaactgctagaactctgttcctgagacttcgtgttgaagtgacaatggattctctcattattttcgtgtgccctgccaatatgacggaagtcaacggtaatctttccaccgccatccccgtttcattataaatgtagggtacaattgcatcgttatacgggtgcatagtattaccatagccaagagccaaaccctcacagctttctctcggtatttctatactgaattgccgcaagtttttgtcttgtgtttctggttcaaaatataactttgagctaaaccaggtaatttgttcgatgttctctttcgttacgtgcacaatgctggcgtcagctaactttatcatggtcttctgttcaaattttatcggccacataatgacaccgtactctgccttcagccactgcaataccacttcattgcggttatctgtcccgcaatagcacaaaaacatcggcacctccatttttgagttccccaagaaaatgaacttagagtaagtgccctcatctaaattagagatgtccaacctcatttcgtaacggatatactcgtcagcggcggtaccaccatcaggatcactgggtactcgaatggtttgaatgtctaaatctacttccaggtttagcaattggttcaactttgctataccattttccagtgaaagttgcttgctgattcctaaaaacttccaagtataaggcattccatccaaaggaagtacgttgatacctatagacaatcaaatcaaccatgcagtcgaccagatcatcccactatggttgttgtctatttcatatcggtgtcggcatttttttttcccgtagtaccactggatctgcctaaatcgcgcttcaggaaaaccagggaccaccctatttttttatatttcatcatctaaattaagtgtatacatatatggataaagtcattttgagtttacataatcgtatgttcgagagaggtctttcataaaaaaatcaagttatcaaccagcatgggattttgggagaacaacaaagattccatcacttcagggctgaagagcgccggtaaatatggttaccaaggaacaaagtacgttgccaagacagggtataaggcaagtaagaagcactataacaacagcaaagcgcgtagggaaaggaagagtggtaagaaaaattcaagtgatgaggagtatgatagcgaagatgagatggagtacgaaagaaagccgaccgatataagaagtttaaaagacccaaagtcctttcctcccccacctttgaaacctggacaaaaaacttatacaggacaacagcaacagcaaatgccaaatggtcaggccagttatgcttttcagggtgcataccaaggccaacctggcgcaggatcgacggaacagtcacaatacgcacaaccacagtataatcagtatccacaacagcagctgcaacaaggtgtaatgccacagcaacagcagctgcaacaaggtgtagtgccacagcagccgcctatatatggagagcaagtaccaccgtatgggtcaaattctaatgcaaccagctaccagtcgctgccgcaacaaaatcaaccccaaaatgcaattccaagtcaggtatctctgaactctgcttctcagcaaagcacagggtttgtctcgcaaaatctgcaatatggtacccaatcaagtaatccggcaccatcaccgtctttccagaacggtcttcagtgtcatcagcagccgcaatacgtatcacatggctcaaccaatctcggacaatcccaatttccatcgggccaacagcagcagcccacgacacagtttggccagcaagttttaccatcacctgcacaaccacaacagcaacaacaagggcaaccattaccgcccccgcgcggtcaagtgatcttgccagcgcccggagagcctctgtcaaatggctttgggcaacagcaacagcaacagcaacagcaacagcagcctctgaaccaaaacaacgctttgttgccacaaatgaacgtggaaggagtttctgggatggctgcggttcagcctgtctatggccaagccatgtcaagtactacaaacatgcaagattcgaaccccagctatggagcttcacccatgcaaggtcagcctccagtcggtggacaaccgcctgtgcctgtaagaatgcagccacagccaccgcaaccaatgcaacagggaaacatctatccgattgagccttctcttgattctactggctcaaccccacattttgaagttactccatttgacccagacgcacctgctccgaagcccaaaatcgatattcccactgtagacgttagtagccttccaccacctcccactcatagggatagaggagcagttgtacaccaggaacctgcgccaagtgggaaaatacagcctaacacaacctcttcggcggcttcattgccagcaaagcattcaagaactactactgcagacaatgaaaggaactctggaaacaaagaaaacgatgaaagtacctccaagtcgtccattttaggacattatgatgtagatgccaacatcatgccacctccaaaacctttcagacatggacttgattctgtaccttctgagcacaccacgaagaacgcaccagaacgggcagtgccaattctacctcctcggaacaatgttgagcctcctcctcccccatcacgaggcaattttgagaggacagagtcggtgctgtcaacgaatgccgctaatgtacaggaggatcccatttctaattttttacctccaccgaagccatttagacatactgaaactaaacaaaatcagaatagtaaagcatcacctgtagaaatgaagggtgaagttttgccagggcacccctctgaggaagatagaaacgttgaaccatcgttggtacctcaatcgaaaccgcaatcgcaatctcaattcagaagagctcatatggagacacagcctattcaaaacttccagccaccaccaaaaccatttaggcgttcacaatcgtccaattctagtgatagttcttatactatcgacggacctgaggcaaatcatgggcgtgggcgtgggcgtatagctaagcaccatgatggtgatgaatacaaccccaagagtgagaattctacagaaaacggtcgtttgggtgatgcccccaacagctttattagaaaaagagcgccaacccctccggccccatccagatctgagaagttacatgagggtactataacatccgaagttgatagttcaaaagatgctaataaatatgaaaagtcaatacctcctgtaacttcgtctattcaagcgcaacagtctacgaagaaggcgcctcctcctgttgtaaagccaaaacctagaaatttttctttaaaggccaatgaatatcccaaggaacttactagggaagcaactggacaagatgaagttttaaactccattaccaatgagttgtcgcatatcaaattaagaaaaacaaacgttaatttggaaaagttaggcggttcgaaaaaagtgaagactctagccctgttccctcagatctagatgaaaaatatgtgtctgcatcggggtctattactccaccaaggcctccaccttctaggtctagtccaaagaaagtgccgcctgttgtcccaaaaaagaatgataacctgaagaaaaagccaccagtggtcccaaagaaaaagccattactaaaatcgctcgaaccaagacctattgaaatggagagggcctattcgggagatatttctgctgctgacgataacttaaatccttttgaaagatacaaacgaaatgttgttcctcaagaagatgacagactgcataaattaaaataatgaaatagctacgcaacattgaacttaatactggctaaatttagttatccgccttggtaaacaatccgtatcctttatttaaactgtcttctcaggaacattacttatctacataaataacattaaccctgtctacgtacagtatatatttgcgtgtggttgtcaaactttagatgaaacgatactcaacgaatactataaaaccagaatggtaagggtaagatagcgggagcaaaaaatcacaaggatgcacctatttagataacaaagcagcgaattgttgaatgttgatctcgcctgatccatcactaacctctcttagcatatcatctacttcggcatcagtcaatttttcaccaatggatgttagcacgtgtttcaactcagcggcggagattaaaccatcaccgttcttatcgaatactttaaaagcttctagtagttcttgttcagagtcatttgatttgagttgacgagacatcagagccaaaaattcactaaattcgatttgatggttaccatcaacatctatttcgttcatcaaatcatttacttctgcttcactgggcgaaagacccaatgacctcatcacagtggccaattcacttgatgagatagagccattgttatctttatcaaagagggcaaaggcttctttgaattcagcaatttgttcttcggtaagattggaggacattgtacttttttatttgtattaactaagctctttctttgtagttcgatagtttccggtcaagaataagatttctatccagtcagagtacccttgtgagttaacaagatctcttgttaaacaccttcttacgcgggcaataaaaaattctaagaataaagtcatatcacagtacacgaaaatataaatacatcttgaaaatgtctcaaattgggtggaaaagagggtgcttgaattcattaggacatatggttgatgttctcaggttctacttatgtttgctttgtcgatttttgcatgctttgactgtgactttcctgtctgatatctttgtatggcttgttgctaaaacaaggtcaatccaagcagtgatcatcttgcacgttgcttcaatagaacgcgcatatagcaatcatcaagttaattggtcatatatctttcaatcagcaattagcaaagccattagagggtaattgtaacggcattttaggggctatagtcaattggtgaaaatgtttttggaaattcctcggtggttacttgccttaataatattatacctttccataccgttagtggtttattatgttataccctacttgttttatggcaacaagtcgaccaaaaaaaggatcatcatatttgtgctgggtgatgtaggacactctccaaggatatgctatcacgctataagtttcagtaagttaggttggcaagtcgagctatgcggttatgtggaggacactctacccaaaattatttccagtgatccaaatatcaccgtccatcatatgtcaaacttgaaaagaaagggaggcggaacatcagttatatttatggtaaagaaggtgctttttcaagttttaagtattttcaaattactttgggaattgagaggaagcgattacatactagttcaaaatccaccgagcatacccattcttccgattgctgtgctatacaagttgaccggttgtaaactaattattgattggcacaatctagcatattcgatattgcaactaaaatttaaaggaaacttttaccatcctttagtgttgatatcttacatggtagagatgatattcagcaaatttgctgattataacttgactgttactgaagcaatgaggaaatatttaattcaaagctttcacttgaatccaaagagatgtgctgttctctacgaccgcccggcttcccaatttcaacctttggcaggtgacatttctcgtcaaaaagccctaactaccaaagcctttataaagaattatattcgcgatgattttgatacagaaaaaggcgataaaattattgtgacttcaacatcattcacccctgatgaagatattggtattttattaggtgccctaaagatttacgaaaactcttatgtcaaatttgattcaagtttgcctaagatcttgtgttttataacgggtaaaggaccactaaaggagaaatatatgaagcaagtagaagaatatgactggaagcgctgtcaaatcgaatttgtgtggttgtcagcagaggattacccaaagttattacaattatgcgattacggagtttccctgcatacttcaagttcagggttggacctgccaatgaaaattttagatatgtttggctcaggtcttcctgttattgcaatgaactatccagtgcttgacgaattagtacaacacaatgtaaatgggttaaaatttgttgatagaagggagcttcatgaatctctgatttttgctatgaaagatgctgatttataccaaaaattgaagaaaaatgtaacgcaggaagctgagaacagatggcaatcaaattgggaacgaacaatgagagatttgaagctaattcattgagtcaatggtaactcagcctttcttttttgaaaattactattttcgactctttttttatacagttacatagtactacctctaatacacattcatgattaacaatgtttcaaacaatataaagtcccgataacgaccttttgaagtggtgacgttaccgctcttcgttgacaagattcaagagggctgtcagaataacagctatcatggtggaaagtaggtgaccctttgaacaaggcagcatatatccatcgactatcatgttcctaaaatgttatcatagccggcgttagaagatggcgcatattattattttattagaatgagttataacagtcatcaaacttagcgaaagccgaagtgtaagaactaaaaagtccactataaaaaaatgaatcacagcgtacaaaaggaaataacgataactgtgatgctatgtaaaactatcgtctttcctttgttgataaatatatcctcaaggactacttcttttatatttcttgtaggtgatgttgtgccctcatcgttaatttgaatcccagcaattatcagacagttctgccgcccttcggcaatgtccaagctgtagccaaatacttaaatcaaggaacactaaccatgtatgacatacaaggagcactaccactgatttcaacagatattaatggtagttttttgcagaatcgtaaggtagatcagtggaaatagtagaaaagggctagtttagattcaaaatttggtaacacgtaacgtcgcgctttggaaaatatacctcaatgctgactacttaagatggcaaatagccttgtcaaatttcctacggaatgttattttcattacgtccttctttttcaatgtacttattcataaatgggacactatcttgttgcaaaaggtactttgtattttggtattaacatctcgcctatttttcatacagaaacactacttatcgctatctatttgatgtggtattgcttggccatgaggataccttgagctacgttttgaacacgtgcatccaacttgtagccttgttgatccaacttaaccatttcatcaggaaacttgtgcaactcaacgctaaagcattcgataaattcattatcttccaattgagtaactggtttttggttttcaggtaaactcatatcaacttcgacagtaaccagacagaggttggtgtttgtgaaaccaggatcgttaaaaactgttgggcttttagaaattattttaccactgtaaccagtctcttcttttaattctcttaaggcagcagtgtcaatatcttcacccgcatctatcaaaccggctggcatctcaatgcatacgccctcaacgggagggcgaaactgcttttgtagcaaaatttcatcaggttttccatctttgtattttagaatggttaagataccaatgccgtctacaccaccggaacttctagtggtgcggactgcgctatcccattccctttccttcccgttgggatctttgtagatgattttttgtaaaccgatccacttgcagtcagatgtttctttaacgtgacgggcttcaattattttagcatcttctggtttacccttgacggtgctcatagttctaaatagtctccttgaattgagggaaataactcttacgtttctcaaaaacatctaagtatgagaaggaaggaaaatgccgaaagaataatcataaaagcatatatacgtgattcatatgaaggctgtctgacgttgtattaaaccgctaacggccgtacttgccatcccttacggaagtgtattcgcttgccggacctcttcctccatgaagaccaaaatgaggaattatgaaaaataaaaaatgaaaattgccataggcatggcttgaccaacacatgcgacaaaatcagaagtaacaattctggccttcactccaatgactatggatactgcgcaattaaagagtcaaatacaacaatatcttgtagaatcaggaaactatgaactgtatgataaaatattataggggttgtcttttttaaaaaatctactttactgactattcagatcaccgtcacatttattagaatttcaaacgaactaaaagccagactacttcaagaaggttgggtggataaagtcaaagatttgaccaaatcagagatgaacataaatgaatctacgaactttacccaaattttatccaccgtagaacccaaagcattaggtatgtgaatattttatcactaaatttattgaaaagagaacgttactaacagtggaatttttttttctagaaatggtatcggattcaacaagggaaaccgttttaaagcaaataagggaatttcttgaagagattgtagatacacaatgaaggatacgaaaatgcaccttaattcccaatattattacatatgctcatcgggaaaaccttttaagcaataatagattttaagtatgtaatgatacaaataataatatatttatatacgcatatatttacatgtgcatatatgaaaaataacctaattcacgttacccacctttttttttagccttttctttatttatatatgtatccacaacataatgaatgaattgtgagctacacaacatttctcgttgattataaattagtagattaattttttgaatgcaaactttttagtcgtcgtagttttcatcttcttccacttgccttactacattttctcttggaagtgtgttctcctgtggggatttttcttgagatgtttgctcttcctcacgcattttggcctcctctttcactgtttccattgtttccaaagtaggtttgattacagttatcgttgtagcagcggtttcatcttgttgtttttcagcatctctggaagctgctggctccgcctcttcagtagaaggtgcagatgcttcagttgtgccgttttcctctttagaatgctgtcttacttcgtcttctacagggcttgcttctgcaggaacagtagcagtagaaagttctatggtctcagcagtgctttggtcatttgcttttgttgttgaactttctgatgatacagttggttggacactagatgactctggttccgtattaagcggttttgtagaaggagaaacagaagctgctttggtagcttcttcagcaggactagcttcctgtggaggttcctgtgcgccaattactgaaggtattgagtttgcttttacaggtttttcttcttgtgaagtattattggtattagactccactactgctggcgattggttgctcacctcagattttgcattttcttcaatggaagtagcagtatttactaatttgttgatgtttgaatttggagagttcaacttttgcttctttacctgtggttcagcgttcgttattcctgttgcgggagcttgcgttggaatggcatgggttggttgacgaggagactttgtgttattctctgtgtgggtgctactggatacggcggcatctactaaagtgtggattgcaccttccatgtatctcttttgaggtaaaacgttctgttccacgttatgctggattaaaggttggggagcttgggcttgaggctggccttgaagttgttgtggatgttgaacagattgtagttgttgctgttgaggtggcagttgagagctttgcggatgttccatagcttgtgtagaaaatggttgcagttggtgagcttgtatgactgttggctgtgtgatatatggttgcccttgttgaggatttaacatttgcacagaaactcccttttgctgcagctgttgtcttggtaggggctgtaattgctgctgctgttgttgttgttgttgttgttgttgttgttgttgttgttgttgttgttgttgttgttgttgctgttgttgttgttgttgttgtgcctgcgcctgtgcttgtgcttgtgcctgtgcttgtgcttgtgcttgcgcttgtgcatgtgcttgtgcttgtgcttgtgcctgtgcttgcgcctgtgcttgtgcttgtgcttgcgcttgtgcttgtgcttgtgcttgagcttgtgcttgtgcttgagcttgtgcttgagcttgagcttgagcttgagcttgtaattgaggggaagctccattactgtacattgttgcagaagagttaataggcgtttgttgagcaggatgctgttgttgtaccattgaagcagtagcattggcagattgggctgaaattctagtgttcaaaggatttccttgatcattaggttgtaaggtaggttgtaaaatcacaggaggtggggcaggagaggcattcgttggcgcaccgttcgatttgtttatattgcctgggttttctaactgctttgttaaagcttctaatctttctcttatgtgaacattatttacgtccagtcttgcagcttgcttatacgcatcaagggcgtcagataattggttgttacaagtttcgtaaagagtacctagatcgtaccaaacttcactaatataaggatttaatcttatggctcttgtgtacgcgtctaaggcgtctctgtattgagaaatttggtaatataaaacaccgattgagcaccaaaagatagggtttcttgaatctctattaacagcttgttggaaagcatcatatgcggcagtataatctgttctaatcatatgcactctaccgagatggtaccatgtagtggcatcggagggatctgcttctaacgactttagaagataatccaatgccttttgagggtcataaaattgtacgttactcataccgtaaagacaacctaattgttgtaatactttggcatgatgttgattttgagccaagacatgctcgtaggcttccttcgcaccttgccactctcccatactctccaaaacactacccaactgaaaccatatgtcccactcctgcaagggagcaggaggttgagggagaatgtatctgaagcattccaaagcttgagaccatttaccctgatgtttataaataatacctagtctgaagtaaatttcgtttgccttttcaaaatgagggtccaattccaaaactttggcaaaagcttcttcggcatagtcgagcgaaccatatctgtcataaagaatgccgattccatgccataatttcggtacgttgggattactgaggtggtagagagcctgttgataggcattgtaagctctttgcagatcatccagcatcagataacaatgacctaaagtagcccacacatctgatagttcgggatttaccaaaagtgctctttcatataattctgcagctctttggaacatgtctctggaacggtacaagtgagccaaagatgttaaagcctttgcagatgagggattgaactgtaaagtggcgtcatatgccattgcggccctgtcgccatcaccaagggtttctgccaaagaagcaatggagagccaagtttccgcagttgattgtgttaatgggtcgagtggctgctgaggaactgctgcctgctgttgctgttgctgctgttgttgttgctgttgttgttgctgttgagcgggttgttccattattgtttgttcaccgcccggattcatttttcctaattttttttttccagtcgtgttttgtttgttgttgttgctgttgtagttgtagtactagtctaaaggcttatagcagtgaaaaagaaaaacagaaatatgggaaaagaggtaacgggaatacgcctctggttcaaagactagtgacgttgtcgtatttggctttgttgattctagttctctcaattgaactcctgacgtggtttgtaaaaaaacagagaacaggaaacaaaaaacaaaaagacaaagaaaaaaatgcgcttttgctttgataatcggaagggaaaagaacgaccgaccgaagaaaagaaaaataaaataaatttaaacaaaccttgttcgagttggataggggaaaaacgccaaaaaaagatggagtacagtacgcgggagaccagtggctagcgacgggagtagcaacgatcgagaaaggagtagcgcagagaaaagaaagaaaatagagagataaaataattagagccgatacggcacccgtgcgatacgagacaggacggaacagtccggtacgtgtggtaagttttacgaaacgagaggacacggcatgacatggcccacgttataaggcaatttccattttagcattggcaaacgcacaagcacaaaaaagatgtggaacaaccactaagaacggagtgtgcacgaaaaaaataagcttttctcgtgccctgagtggtgcacaaaagaagaaaagggaaaaaaaaagcgaacgaggagtgacgtggacgcgatgaaggtgactcagccaatccgggtgagccgcacccttcgtcctcagtgacctctcacgtgccctgtatcagccagccactgacagttttgtttttgccgcccagctcaaaactcagatcggatgtgctttagtttttatcttcgttatgtggatgtttcattagcttaaagcataggataccgagaaaccgtaacggtttcatgttgaccggtttttgagtttatggttttaaagttcgtcagttgttccgacgcttagattttaaggagcttgtcaaaatgcctaaaccacaatccttacagcactcaaaatcaacaaaaagtgagaaggtttgaaagtagtacatcccctcttccctttgatttttagccgccaaaactaccaacccacacagcacaaaatgtgttactcctcgaaaaaatctgttacccttttcccgccatggttgccagggaaacagtggggacttctgcgttgcttctatttttcccccctccttcctcctgcgcctccgtttctttttcttcccttttcatttcccttttcttttttttttcaagtttcggattaacgctataaaaaaaatgcacagataggaccttaaggactaataaaaccgacagtataacgacgtaatgctgcgtggtgttttcaaaccttagtagttttggtaattttagatactcttggccgtataactggtgtaccaactgaaaaatcatgcaagaagggggctttatccgtagaaggcgtacgagaagtacgaaaaaaagtgttaattataatgaactaagcgatgacgatacagctgtgaaaaactcaaaaactctgcagctgaaagggaacagcgaaaacgtaaatgacagccaagatgaagaataccgtgatgatgctacgctcgtgaaatcacccgacgacgatgacaaagattttatcatagacctaacaggttcagataaagagcggaccgccaccgatgagaatactcatgcgatcaagaatgataatgacgagataatagaaatcaaggaggaacgtgatgtttcggatgacgacgaaccgttaacaaagaaaaggaagacaactgctaggaagaagaagaaaaaaacgagcaccaagaaaaagtcaccgaaggtaaccccatatgaaagaaacactttgcgattatatgagcatcatcctgaactaaggaatgttttcacggatttgaaaaatgcacctccctatgtcccccaaagatccaagcagccggatggtatgaccatcaaactgctacctttccagttagaaggtcttcattggctaatatctcaagaggagagcatttatgcgggcggtgttttggcagacgaaatgggtatgggtaagaccatccaaactattgccctattaatgaacgatttgactaagtctccgtctttagttgttgcccctaccgtggcgctgatgcagtggaaaaacgaaatagaacaacatacaaagggacaactgaaaatatacatttatcacggtgcttccagaaccacggatatcaaagatttgcaaggctacgatgttgtactaaccacttacgcagtgctggaatcggtattcagaaagcaaaactacgggtttagaaggaaaaatggacttttcaagcagccttccgtattgcataatattgacttttatagagttattctggatgaggcacacaatatcaaggatagacaaagcaatactgctagggctgtaaacaacttaaaaacgcaaaagcgatggtgcctgtcgggtactccgctgcaaaatagaattggtgagatgtattctttgatcagattcttaaatatcaatcctttcacaaagtacttttgtaccaagtgtgattgcgcttcgaaggactggaaatttacggatcgcatgcattgtgaccattgtagtcacgtcattatgcaacacacgaatttcttcaaccatttcatgttgaagaacattcagaaatttggtgtggaaggtcctggtttagagtcttttaataacattcagacattattgaaaaacatcatgctgcgaagaactaaagtggaaagagcggatgacttgggtctaccgcccagaattgttaccgtgaggagagacttcttcaatgaagaggaaaaagatctttacagaagtttatacacagattctaaaaggaagtataattcctttgttgaggagggtgttgttctaaacaattatgcaaacattttcaccctaatcacaagaatgaggcaactggcagatcatcctgatttagttttgaaaagattaaacaattttcctggcgatgatatcggcgtcgtgatctgccaattatgtaacgatgaagctgaggagcccattgaatctaaatgtcaccataagttctgtcgtttatgcatcaaagaatatgtggaatctttcatggaaaacaacaataaacttacttgtcctgtttgtcatatcgggctaagtatcgatttgtctcaacctgctttggaagtggaccttgattccttcaaaaagcaaagtattgttagccgtctaaacatgagtggcaagtggcaatcatcaacgaaaatcgaagcacttgtggaagaactatacaaactgagaagcaacaagagaacgattaaatccattgtgttttcccagtttaccagtatgctggatctggtagagtggagattgaaaagagctggatttcaaacagtgaagcttcagggtagtatgtcaccgacgcaaagagatgaaaccatcaagtatttcatgaacaacattcaatgcgaggttttcttggtcagtttaaaggcgggcggtgttgctttgaatctttgtgaagcttcgcaagtattcattttagacccatggtggaaccctagtgttgaatggcaaagtggtgatagagttcatagaattggtcagtatcgacctgtgaagatcacaaggttttgcattgaggatagtatagaagcaagaatcattgaattacaggaaaaaaaggcaaatatgattcatgctacaataaaccaagatgaagctgccattagcagactaacgccagctgatttacagttcttattcaataactaatattttattctcttattatatattattctcggagtttttaagtgacatcacccgaaaagaagctaagtctttctcctaattcatatttaattattgtacatggacatatcatacgtaatgctcaaccttaagctgctgcggagcttccacgagcaccagcacctgaagcaactagacttatttgcgcttgagttagttctatacttggcagtggaagtttgtcattatgagttggtggaggtaaaaatccaaccttgtttaaaaatgcaatatatataccaacctcttctggagtaacacctattccattagaccaatcaacacctgtccatgcggtgtctttctttaaagatgccacggcgttcctatcgtctagttccggagctttggtactttcaggtaagttgtctaagaccatgtgtagcaaaggatacaacgcattttcttcattcctgtcaataacagacgcctccaatgatttcttccatttagaatagctttcgatttcgacatcgtaaccataatcgtgtaaagtatacaagtagtctttgaataatattcttgggtgacccgttacttgagcaacggccaattcattttctttgggaggattcaaagacgtagcaacaacaacacgagcaacatgatctactggaaccatattcacggaattttcgatatctggaatcttacctaattggactgaacctttcaaaaatctcaataagaaatcatctgtgtttgaagaaccattggcagaggcacctgttacgtaacctggtctgacaatacacccacgtaggcccctttcacctgcacgtctaatgatgtactcagcagcccatttggactgaccatatccaccagtgagcccgcttgcagagttcattaaatcgtctgattctaaaatgcctggcttcccttcgctaacaagtttatctgacaaattaaagtagtattcagtgtcaagagtagaagtggaggaaacaaagtcaaagaactttggcttgccgacggcggctaagctcataacattgatagttgaaataacatttggatccctcaatttggcatatggataaacccagtgaactaacgcaccattatggataattatatcaactgtgtttgccaaatccatccacttctcatctgaaagaccaaattggcttttagataaatcgcctaatacaactttaatatttgaggcaaatttttcgttccaagtaccataggtgatacctgccttttgtaatcttgcaaatgcagcttcttcatccttggccctgacgtgggcaaacactttgaaactgtagttctttggagaacgtcctaacaaatctgcaaggatgtaggagcccagaaatcctgtgacaccggtaacaaacacattaattgttgtttttccttcggcactattaggttcaacaaaatattctcgagaggggtacgaacttggtagcgtctcaaccaatttcttggcgtcttccgcataatttgcagtgacattttcgacgacctcaccttgagatgatccacccgatgatttaattctgtcaatttccgcggcaaaggcctttatcgttggatacttgaaaattgtgcccaatggtaaatcaacttgcagctttttctttaaggtaaaaatcattttggtagccaagatagaatgaccacctaaatcgaaaaacgaatcatctggtgatacagatgctggcttggtaggtaatatacttaaccataagtctctaacctcgcgctcaacattggtaaactgagagtcgtcagtttcagaaactgtattttcagctaccaaatttaattgcttgggagttgggaattgaagtttaggcttatcaactttaccatttggattcaatggtagtttatccataaccacaatcaaggaaggcatagcatagctagccaatcttttctttaagaaagtcctgatgtccttggataaaagatggtaaccgattaagcccttaactatagggtcagtttcaacctcctttggaacatcactttggaacttagacaagtcatctggcttgtcaaatcttgggaccataaatgtgatcaatgttggctcattgtcggcatttttgcgaactaaagtaatgttttctcttaccaatggatgttgggaaatgtgcgtatctatttctcctaattcgattctgaacccacgaattttaacttgatcatcagccctaccgcaacattcacagtcaccgtttggtagataacgacctaaatcacccgttctgtacaatctatctcttggacctaaccagaattgtctccaaggttcaccattatccttatccaaataattccagtgatctttttcaacaaaccagttgttcacaaatttttctttattcaattctggtaatcctctataaccttcggccaaaccacctgcacgaacataaatctcacctatttcgccaataccacatatttgagtacgatcgttcctgttaacaactagtagctgaacgttcaacatacctttaccagcaggcatgacatctttcaattttttcaaaaagtttggatcgtcattttttgatttaacttcgaaataagaaactgcacgctgtgtttcagtggtaccgtacatattaacaatacggcaattttctgccaaggtttgtaacctcagacaatcacgttttgttaaaatgtcacccacaaagaacgcatgatgtaacttagggaatggtgtagtagcttgggcagtaagtaattgacccatggcaggtgttaaatgggtaactgtgcaaccatacttactcatccattccgctaaacggcccggtgtaccaatatcatcttgagtagggacatacaattgggcacctaaaaataatggtgtaaacatatctctttgaattggatcatgtgcaataccgctcagcattgtgaatttatcattttctgttaagttgaaccttttggacatccaattgaaataataagccaaggaaaaatgtctaccaagaacacccttaggaataccttcggaaccagatgtgaaagatagggttgggttggaatctggtccaactacaacacctgttctggtgtctttgtagtgatcatatggagccaaaacatcctcgccattgtccaatttgccaccttcaatggtaccattttcttgaatagcgatggaattgattcttgaaacaatctccaattcatcattgatgtaatcttctactagttgatccaattgtccagcagctctaataacaatcaacccacgtggtttagcaacacctaagtaaatggtttgtctggctgggggatatgcagggtcgataactgaaaaggttgcgccggctttcaagacacccatcacacataccatcaaatccacacccctagaagaatagatcatcactacatcacctcttttgatacctgttttaatcaaataatgggcaactatgttagaagtgcggttgatgtcgcgataagtgaaagaacgggacttgtcggaatttagtgttggagtctccacaacacaggttctctctgggaaggcttcagcattgtcctggaaaatgtcgtgaatacaccccacgaaatcgcaccagcccaagttcttagttggatcaggtaaactatccttggatgatgcggtgatcagagagattttagttatgcaattggatggatcgcttagcgcagcagtcaaatattgagtaaattggtccgcaacaatggttactctttcattcgaatacagtaagctgttataaattaagttcaaaacatgcgcattattactggtatccaaattcaaagcaaagtccactaaatgatgcttgaactcgtctaatttgaaatcttggttttccaaaaaggccaaacggaacaactgaggggtcctttccagatcttggcaactttgaattttttcagctagctcgtcaaaggaaaaattggcctcaatagaattgagcttgttcaactcattgttaattgtagaatacagctcattaaatgaccacgttggttgaatattgaatcttaagattttgttattcgcaatataaagaacaatatcatcgtcaccggttactctatatatcaatgcagcccatacactcaaagcgacagcgtatttgttagaaaaactatcatgaggcacatcgagctgaggtagctgtaacgaatatgtagcttgtttcgtataaggttcttgttgtgggcgtaaaaagtcatgtggtaacactgaaagagttggattatccaacttctctatccagaccttttcgttagtcattagtgagtaactctgtgatatctctctataattagcagtttttcactgaaattccaggaaaggtaataaactcagatttttttttatactattggctgcttgttacttatatatcttgaacttctcccagcgggtcttcaaatacatttgggcgatgttcatgttcattaggcaggtatttcgacattgagtcacacgcgaaaaaccgccggaattttttatgtaattgcaagtggaattccgctggcaaaactattgaagagttttcctcgctaaaactgtgcgatgcctctagaagcggtcagcaagaagaaaatcgaataatcagtttcaatgaatatagacgtaacaaaggcacaaaaaagaaaacaagtacatatgtcatacatatatatatatttcaggcagcaagtgaccatcaaccaggaagtgtgaaatagcaaagaactgtttacttcttcagacttagaaagctcttcccataggagaaagcaactgctttcctttgtagtaattgattgtcttttcagcccttgacgcaacaccgtccgctgtgaaatcgaacaatttgtaaatttcaggccccttgcctgaacgaccaaattcgtcgagtccgaacgattgatgagcatacttaccccagcttgaagtagccaatacttcaaaggacatgatcggaacaccgtctggtagaacagagaatctgtattcttcactttgcctgtcaaaagtataaaagtctggcagggaaacaactcttgctttgatttttttagtatcgtacaattttttggctgcatctatagaaatggagacttctgatcctgttgacaccaggataatatcaggattctccacgtcatggatcacatagccacccttcaaggctttttcaaaagaggaatgctccaattgaggaagattctgtcgtgataaagccacaacagatggtgttcgaccagatttgatagcagaataatacgcagcagaagtttcgttaccatcagcaggtctccatacatgcatgtttggaatagccctcaagtgagccagagtttcaataggttggtgcgttggaccatcctcaccaagcccgatagagtcatgtgttgcaacccaaatgactggattaccagacaaggcggctaacctaacggctcctgcagcataagagacgaagttcaaaaaggtaccaccgtaaggcttgtagtttgcaccaaaggcagagataccgttcataatggcacccattccgtgttccctcacaccgtatctaatgtaccttcctgcatagttacctagttgggtaatgggaggttggaaatctaccgcgccttcccaccttgtcagattcgaaggtgtcaaatcggcagaaccaccgatcaattcaggcaaaacttggaccatgttcgtcagcacctgctgggatgtctttcttgttgccagagcatcgtcgtccggagtaaacttcggtaaatgcttttcccaaccttccggtaactcaccattcaatcttctttgcaattctttacccttctcgggaaatttggttttgtattcttcaaacatcctatcccattcctcattaagtttttgaccgggttccacaacagtcttcttataataatcgtacacctcttgaggtactacaaatgatttatttgggtcaaacccccacctcttcttcaactgtttaacatcatctgccttcaaagcggacccatgaacaccagcagtaccctgttgtagggacccaaatccaattgtagtagttaccttgattatggttggcttgtccttcgatagttttgccttttccaaagcgctagaaatggattccatatcgtcgtctcctttatcgacttccatgacttcccaaccatatgcctcgtatcgcttcaaaacatcttcgtcgaacgagtacgaggttttaccgtcaatggaaatgctattactgtcataaaacgtaatcaagttacccaattgcagatgtcccgctaaggaagaggtctccgaagaaacaccctcttgtaagcaaccatcccctacaatagcaaacgtatatgagtcggaaatgggaaagccatcctcgttataagtggcggcaaagttggcctgcgctattgccataccaacagcatttgagataccctggcctagcggaccggaagtgatttccactcccgctgagtggaattctggatgacccggtgtccttgagtttacttgtctaaattgtctcaagtcctcgatagagtaatcgtatcctaatagatggagcattgagtacagaagagcgcatgagtgaccgttcgacagaacaaacctgtctctattgatccaatgttcattgttagggttacagcgcagttgcttgaaaattacatgggcaactggtgccaatcctagtggtgcacctgggtggccagattgtgcgctttccacctggtcaacggaaagtaatcttaaagtggaaaccgcaagtttatcaatgtcggagaactgtgccatttttttgttctttttttgattagtaaggtataatcgtctacgtagaggttacaaatcgaagactacagtaagaggggacaagccaattgaatatacgactgaaataaatggaataattctgcattattacactcgtttatatatccaaacaggtgatctggtattctcttgacaacgaatgaagctccctatattcgacactccttattcaggactcctcccaacaaggagaagtaggtgttccttgagctaccctttaaagctggggagatgagcttgcccttcctgtcatcgccattatgacgagaaaagtaaaacatgtagaataaggtccacccaaacatgtccgagcaatgacgttatatatcgtgttccctgttcaaagcatggcatatgtgccattaaaggcgaatttttgtccctagcaaaggagagacagcgagccaccattaagaagtgacttgaaagcaagcgaaaatagctacacatatatatcaatatattgacctataaacccaaaatgtgaaagaaatttgataggtcaagatcaatgtaaacaattactttgttatgtagagtttttttagctacctatattccaccataacatcaatcatgcggttgctggtgtatttaccaataatgtttaatgtatatatatatatatatatatggggccgtatacttacatatagtagatgtcaagcgtaggcgcttcccctgccggctgtgagggcgccataaccaaggtatctatagaccgccaatcagcaaactacctccgtacattcatgttgcacccacacatttatacacccagaccgcgacaaattacccataaggttgtttgtgacggcgtcgtacaagagaacgtgggaactttttaggctcaccaaaaaagaaagaaaaaatacgagttgctgacagaagcctcaagaaaaaaaaaattcttcttcgactatgctggaggcagagatgatcgagccggtagttaactatatatagctaaattggttccatcaccttcttttctggtgtcgctccttctagtgctatttctggcttttcctatttttttttttccatttttctttctctctttctaatatataaattctcttgcattttctatttttctctctatctattctacttgtttattcccttcaaggtttttttttaaggagtacttgtttttagaatatacggtcaacgaactataattaactaaacatgggtaaagagaagtctcacattaacgttgtcgttatcggtcatgtcgattctggtaagtctaccactaccggtcatttgatttacaagtgtggtggtattgacaagagaaccatcgaaaagttcgaaaaggaagccgctgaattaggtaagggttctttcaagtacgcttgggttttggacaagttaaaggctgaaagagaaagaggtatcactatcgatattgctttgtggaagttcgaaactccaaagtaccaagttaccgttattgatgctccaggtcacagagatttcatcaagaacatgattactggtacttctcaagctgactgtgctatcttgattattgctggtggtgtcggtgaattcgaagccggtatctctaaggatggtcaaaccagagaacacgctttgttggctttcaccttgggtgttagacaattgattgttgctgtcaacaagatggactccgtcaaatgggacgaatccagattccaagaaattgtcaaggaaacctccaactttatcaagaaggttggttacaacccaaagactgttccattcgtcccaatctctggttggaacggtgacaacatgattgaagctaccaccaacgctccatggtacaagggttgggaaaaggaaaccaaggccggtgtcgtcaagggtaagactttgttggaagccattgacgccattgaacaaccatctagaccaactgacaagccattgagattgccattgcaagatgtttacaagatcggtggtattggtactgtgccagtcggtagagttgaaaccggtgtcatcaagccaggtatggttgttactttcgccccagctggtgttaccactgaagtcaagtccgttgaaatgcatcacgaacaattggaacaaggtgttccaggtgacaacgttggtttcaacgtcaagaacgtttccgttaaggaaatcagaagaggtaacgtctgtggtgacgctaagaacgatccaccaaagggttgcgcttctttcaacgctaccgtcattgttttgaaccatccaggtcaaatctctgctggttactctccagttttggattgtcacactgctcacattgcttgtagattcgacgaattgttggaaaagaacgacagaagatctggtaagaagttggaagaccatccaaagttcttgaagtccggtgacgctgctttggtcaagttcgttccatctaagccaatgtgtgttgaagctttcagtgaatacccaccattaggtagattcgctgtcagagacatgagacaaactgtcgctgtcggtgttatcaagtctgttgacaagactgaaaaggccgctaaggttaccaaggctgctcaaaaggctgctaagaaataagagtaataattattgcttccatataatatttttatatacctcttatttttatgtattagttaattaagtatttttatctatctgcttatcattttcttttcatatagggggggttggtgttttcttgcccatcagattgatgtcctccaactcggcactattttacaaagggtttttttgtaagagaaggagaagacagatactaaaccatacgttactcgaaacaaaaaaaaaaaaaatggaaaaagctgctatcaacaaaagacggcctcatcaaacctaaagaaaccatgtcagcgtatgtatataccttgtaatttacgtttccttaaatcttctttctactaacgttttcattattctatactctatgaccaataaaaacagactgtactttcaaaatttacccagtaggccagcaaataaagaaaattataccagattacttctgaaacacattaatcccaacaacaagtatgccattaatccgtcgctaccccttccccacaataaattacaaatatcatcacaaccgctgatgttactagatgatcaaatgggccttcttgaagtttctatttcaagatcatcaaagatgactaaccaagcatttttaacgtttgtcactcaagaagaagcagaccggtttctagaaaaatacacgacaacagcattaaaagttcaaggtcgtaaagtgagaatgggaaaggctcgaacaaattcgttattgggtctttcaatagaaatgcaaaaaaaaaaaggtaatgacgaaacgtacaaccttgatataaagaaggtgcttaaagcaaggaaacttaaacgcaagttacgtagtgatgatatatgcgccaaaaagttcaggcttaaaaggcaaataagacgcctgaagcataagctgagatcaagaaaggtagaggaggctgagattgataggattgtaaaagaatttgaaacccgtagattggaaaacatgaagtctcagcaagaaaatctaaaacaatcgcagaaacctcttaagcgggctaaagtgtccaatacaatggaaaatccaccgaacaaagtccttcttatacaaaatttgccaagcggcactaccgagcaattattgtcgcaaatacttggcaatgaggctttagttgaaatcagattagttagcgttcgtaacctagctttcgtggaatacgagaccgttgctgatgctacgaaaatcaagaatcagttaggctccacttacaagctacaaaacaatgacgttaccataggatttgctaagtagaatttcctttgcggaagtatacctcgagtaaagaaattcacagataaatttgaataacgttctccattatgaataaatatgtatttacaagcttagaaaataatgtgctctttatttaccaaataatacagttctcattgcagtaaataagctttcctttttcttaccgtcaacggcatttattaaccgttgataatattggggatttcctgcaggtttatagagcttatcgccaatatcgtaatagtttctgaatttattattcattatagtgctcaaggcacgaatttgctcgttgatgctttcttccgtgaatttctcatctaccattttattttgaattttggttaacatctccttattcagtcctaatggaccggaagttctgttaattatactttttatttcatctaatgagggttttttctcttttatagattttcctttgtcatctacatttggcagacccgctacacgtctaaatcttgctatttgtacatccctgaatgagaccaagtggtgtatacgatcctttggatatttttccagtaaattaactaattttttggcagaatccctgacgacctgggaagaagacattttggcacttgcttgtggaatacggagtttaacttggtaagctgatagagagaatgtttcaatgaaggctacctttttttcttataatgttgctaccacaggaaatcttgatatacgttaatgttttggcccctacaaggccggaaatatttcgctttttcttgatatcagaatttttcgcatgtccgaccatgcgcagagctgctatgaaagtactttaactattagtgtgaggaatggctaaataaacagcagatgtgatttccgcacttcttttataaacttccaaaataatcgtattagtggacagtacataatcatatcttgcaatacgtatcaatagtaaacgaattatttattcatacacacatgtatatacttctcgcttctttttttaatttacatgtttggcgatatatagttaaaattaagtcatttatttagtcagtttcagcttcagcttcagcttgggcaataaaaggagtcaaatccttggtaccttcttcccaagaagcaccattgtaagtgatatcgcggatagccttgatgacattttcgacggaacctctaacttgcttggtggaatctctttctctcaaagtgacagaatggtctttggcagattcaaagtcaatggtgacaccgaatggagtacctaattcgtcattacgggcatatcttttaccaatggaaactccagaatcatcaatcttaaatgggatttgagactttcttaagattttggcgacttcatgatgaacaggaactaaatctttgtggttagataaaggaactaaaagaacctttgttggagcaaccaaaggtgggaaggaaagaacacttctggcattgtcttctggtctgttccagaaagagtgctcaaaaacggagtagatgatacggccaataccgaaagatggttcaatgacactaggaacatattctctaacgtgttcaacctttgttctttgttcgattttaaccaatttatcgtccaactcgacttcgccatcaacaccatcaacctttatagtaaacttgccatttgccttcaataactcagccttggaagccaagtcatcttgagacatattcaatagatgagattcaacttttggtgcatcttttctgaattttggaccgaacaattttttcgtcaaatcaatttcccacttggtgacttcaattggattatctaatttttgtctaacaaccaatttttctttggtctttttggaatgaacggtcaaatcataggcagatctatcagcacatccgacacattcaatccacccgtaagatgtcttcaattcaccatcccaacagtcagcagcataatgtgccatttcattagccatatgttgacggaatctcaatttggactcatcaacaccaattttcatcaaaaattggtaaattctggcaataaagtaacccaaagtttcattatcgaccattcttgaagcaactgcttcaccaactgtcttgacaattggttcagtagaaccagcttcttgaacatcacgaggcaaaaaggaaagcttgatgtctttgatttcattaaattttggatgagatttgtccaatgggtcaacgaaatgttcaatctctgccatcaaaaattcacggactcttaataaaccggcccttggggaaatctcatttctaaatgatttaccgatagaggctgaggcaaaaggggtcttactgttgttaaattctaacaacttgttaaaattcaagaattgaccttgggcagtttctggcctcaagtaaccctttaattgaccagatgggccaatagccgtttcaaacatcaggttaaaagcccttggagattctaaagtttctccggtgactgggttaccgatatcgtatttttccatcaattcacctaattctgggccggaataaccatctattttagccaaaatttcttcatattctttgacaacgtcgtcatccaatttgactgctttaatttgtttaacttttttctttctcttcttcttttcggcatcgtccttagcagcggcattagcatcctcgactaaacctctggcttcttggtcaccctttaagcgagcttccaaaacttcttcgactaaatggtcagctctgaaaatctcaccagtcttcaaatctctacacatccaatcagaaaatttgtcaacatgacctgaggtcttcaaaacctcatatggagttaacatagtacaatcaacttccaacatatcttcttccaaaataaaatgctttctccaggcgtcaatgatgttgttttggaatgcacaacctggtggaccatagtcatataaaccagaaaccccaccgtacaagtcaaaagctggggcataaaaaaatcttcctctcaaaacactttctagctgttctctgttaaatggaacagcggctctagccttcttgatatcttctacactcattcttttaatcttaaccgattttttaacaatctgagagtaaaatcgtctactgatattgaagaacgacaatttttcttgaaaatcaacacgaatgcaaaaagggaaactaaaataaaagaaatcctcaaaagtaattgaacagatttcgagtcctaattgcaagtaaaattatgtatacaaagtacgtgataagtatcgcagcagtgattcaacactcgagaagagtaaaaattttcaatttttttccactgcgctgaaatattacgaggcgtagaaaatgatcactacaatgccgttgctgcttattgcagcgtaagtgagcttcattcacagaccatttgcctcgataatccatgaatcatatctggttcatattatgtttgtaaatgtgtgtcttgttgcacttaatctatcgcgatagcgccaaaccaagcgttcgcagaatcttcgttgtcaatatatacatatgtagacgtatgtgtatatgttgcggtatatacaaggctgtttatgtagtcttcaaacagatgcgattgagatctatgtcccaaaaggaatataaattggttcgagaatagaaaagtaaggggagcaaacactattcacttcttgtctctcttcttactggccaacttacctgatttgatctgttgttcactatcgtctaacagagatagatagtcatccataccgaacgctttttcagaaacgtcttccttctcctcctttttaatctgtgttttctttttattttcttcagatagttcaactgtttcagagcttgaatttggggtcgttgaatcgacagaaaacaaagagctatacctcttgttaaatctgtccaagctaccaccagaattagcatccacaacgactaggtcatccctgctaggattccacagcggattatttctctggtcttgaattaatctaatttcaccctttggatattgggatctccggataactacacttccatcactcaactccattttgacattgaattggtgataaatagccggtcgtgacttccccagttgaattttttttgcaggccttcttggcaaagtaattcttgtagaaccaggatatgaccctgtggaagcaaatcgcttcgcaaatatagacttcaacattaggagtgaacaaaacgtgtgttcgtttgcgttggtacccgttctttctggaggcattcttaacttttaggaataataatgataccctttcattttagttatttgattttgatgcattttgcacgagataatcgctctttacggtttggggacaaaactcagaaatatcacatacgtagttatggttttattgcacatttggcatattttgatattgaaataaaagaaaacctacttattacagatcgacttcatcaacaaatcccttgagctcgcttttcattgtttccgcggttttaggatctagtttagctattttatttatgatatcttggaagctcgctgttttaacatcaaaactttcttgttcttcttcatctgcatcaacgtcatccacgtcatcgtctatacttgcaggcaccttcaagttctgatcagtgtccatctcttcattttccaaagcagcgtcgtctggctcttcagttatggcgccattatcatcaaaatcatcaccagcagcgatacccttatcctcctctatggcatttgaggacatttgactacctgcatccatatttatgtccccatcagcatctttattggtgttaacacccattccctcttctgagttcttgttttcgggtaccatggattctttaacaaataacattgtcttgaaatacttcaacttgtatttattatactcataatttccttgaaccatgcaaccaagttcgtattttactatccttcttatcttgaccaagtctaattctttgaaccatccagttagttcattcgccttatctaaatattcgacgttgtgaaaaacttctgcaatgtttggctcaccaattaataaatcaatctgcaacatcaggtaccacggtattctttttccatcaaatttgaacctgctgtcaataccgcctggagtgtctgattcgaataccaggggtggtggctttggtacattctttttcactatgggagaagatagtaatttcctttcaatcttaaaatattctgtttgatattgggcgtattccactgaacttctggggtctataccaaatttgatatatgtatttctccaaggccccattgtgaaacgataagatatgagtgccagcgctatcttcatagtatggtgtatcttcttcgggacaatcccatcaagatgtcttttaacccaaattggacgtctagcgaagagctctctcaaaattttcaagcattcctccagcgattcataaaatttagagtcacttttagtgcctggatagacttttgttttcttcgcgacctcaaaatcgtacaggacttgttcatgagcttgggacggtataactgtcttatcactaagatcatgaacaaacaactgatagtttttgatatatgttcccttcacttctgtgacaccgttttttttttttttcgcaaatggattagctttatatttataaagcagggggaaaccaaccattgataacttaggaggtggcggcagttggaaatctgtactcggaattttaacgctacggtctaagatcaaattcccgatgttttcctgaggttgagagtcattatctggtacagaattgacaaaacttttgaaattattccattccagagagccaaagctacttttgaactctcttgcagaggggacattatccagtttgatttgaaaatctgacatttctctaaattttatagtgttatctactatggaaacaggagtgactctcaatttattcgaatcttttaaggatttgatagaatctttgacgctattattatttttacttaaagttcccttaggcattgtaacctttaatatgaccgactcatctctgaagggaactcttttaccaattacaggatgctcattaaaatagctcttggatccgtcgctatcagtatcatcgtttaagtacagttgtaatccgtgctgagattcgataggtccatgttctttaaaggcttctttcactttttcgatgcccccacacatttttatagccttctgtatactagagtgttttgtggagacattaagtggcaattctaaacttggaattctgggcaggtctaacgtaaattcatctgctattaacggtggggcctggtccgcgctagaatctggaattgatgaaagtgtagcaagaggctcctccactggcattttcacgatttggaagatattttcgctcttgaaagctatagagattaattatgtttttcccttggtataccttttctgtgttgtctttcagttcctgtctttaggatgttatttatcgatctttttcagaaagaccaaaagcgaagaagcgaagaagaggacttctctgtactaagaccaaattatgtaaaaggaaaactaaacatgaatatgtgaatttatttccaaaacacagcagagcttaaagatggggtaaactcatattcatattcatatacacgtatgtatataaaaattcatttaaaaggattgctttggttttctacaacactaaaaagcacaataaaataataaagtaaaaaaaaaaatgtgataatgaggtcgttttaaggtacttttgttatttcatctcccaagcagttgatcctatacactaatacacagacacattaaccacacgttcagatatgtatgagaaaaaggaagaagaaaaataattttttttccttacactaggcccctttctctttccaaacgggtcttcattttattaaaccagtcttgcaatgtttcgcctttccggtttagcactacaatgatggcagtcatattgtcaaagccgacaccagtattgctatttgcctgcgctatcccgtggtccaacaattttgttattattgtatccaacttcgtccctgataccaggtgatactttataaagtgaattaactgtttgttgttataaatatcccatataccgtcgcaagccagtactaaaaactcatctttagaatagtcaatcttgtgcatcaatacgtctggttcaacggtaacttgtgcttcttgtggtggggttccataagttaaattctgggtaatatttgttagttttgtccttctatgtggataagtgacacctctcttgaattggaaatcactaaatgccctactgagagccagtactccacccactcttccaagagagacagtaccaccattatcgtttatacgtatcaattctcctatgtgttgtggcttatgatcgaaagacatcgtctttatgccattcgatttggaggaaagaatacatcgcgaatcaccacagttagccacatacagtgattcctcgtttatgatgcatgctactactgctgtagatccacacgaactgttggcaaaatgtcgatataactcttcatcttgcaatatgaaagcgtctttaaaaatttgagaaacaagtccttccaacgtattgaaggatcttttaaattttgatgagtcgttattagttgtagatgtgtaatggtggttttcgaaactatacgcaatccatttgatcaggccagcgttgggttcaccattaccgttgctactgccgttaccatcgcgatggtggcggccgccgcttagaaatttcgaacaatcatctccaccatgaccatcgaatactgcgaagacgttcaatgacagggtttcgtatttgtctatgaatgggttgaaaaatcgtacgtacacaacagagttttcatttctaattagatgtgcatcttcctgagtcaaacgatagccttgcatggaccccacacaattgtaaaatcgtggaacaataccagttgacgcctggttgtttttatattcattatattctatggtcttctccgtcaacggatgggaaagcaattgacccatttttgtcttcttcaaattgaagttactttctaaaatggctatataggggagaatagaggcaaaaagggcgatgggatagaaaagaagacgtaagggctccgtgctaagaaagaagaaaaagatgcagttgaaaacaacgtaaaactagagatccaatgtcaattgtttatgtagccaatatcttcgttatgcggtgtgaacagcgacaataaaaaaaaatgtgggtcaaattatggcttttttttcttgatttcctttttctttttattcatgatgtttcgaagaagagatcagcgcgggagagaaagaaagagagagaaaaagagggcctatacggtgaaaaaactacttgcgcagcttcagtaacagcgctacagacaggcgttaacgaataggagaggacgtgtggcgtttcagttatgtcatttatataattttatataaagtataaaaaaagtgaatagaagagagggcagagaaaaccggaccaggaatagacgatcgtctcatttgcatcgggttcatcagtttttggtggcagaggagcttgttgagcttgatgatgtactgtataattcatggacgaaattttcaccccagaaggcagaagtgtatttagagatgtatttgtaaagtttttcccagttaacttctttctttacatcgggcaaagtcaaggcctcgttgatggcatcagaaagatcatcggtgttccaaggatttacaataatagcaccattcaaggattgtgcggcacctgtgaactcactcaggattaaggaacctttcttttcttcttggcaagcaatatattcgtaggaaaccaagttcataccatcacgggtggacgagaccaaacaaacatcgctcacagcatataacgaaatcagctcttcaaatggtatagacttgtgcatgaaatggatggggacgaattccacagtaccgaactgaccgttgattctaccgaccaactcattgaccacagatcttaaatattggtactcttccacatctccacgacttggcactgcaacctgtaccagaacaaccttgcccctccattctggatgctcgttcagaaacacttccatggcgtgcaacttctgaggcacacctttgatgtaatccagcctgtcgacaccaactatgatcttgcagcccttgaaagtttccttcaattgttggattctcttttgtacggattcctttttcaacccatcggtgaacttgtccacgtcgataccgatagggaaggcccctacgttaacgaatctgccctggtattccaccccattaggcaatgtgttcacgttaagcactctttgcacggaagacaagaaatgtcttgcataatcgtatgtgtggaacccgactaaatcacaactcaaaacacccttcaaaatctcttgtctgacaggtaagattctgtaaatttcactcgaagggaatggtgtgtgcaggaaccacccgaccttaacgttttgcagttgcttctcgtgaatcttgactctcaacatttccggaaccaacatcaaatggtaatcatgcacccagattaaatcgttatggttcatagtcttagcaatctcgttggtgaacgtctggtttgcctcgttgtatgccaaccacgcattctcgtcgaaattgatctcaccaggatggtaatggaataacggccatagaatagaattactgaacccgttgtagtgtaagtctgcgatttcatcgctcaggaagatgggtacggcattaaacttttccagcaagtccttcctcacctgatccttctcatcgtcaggaatctctagcccaggccatccgaaccacttgaaagtgtacgtcttcttcaacccttccaacgccgtgaccagccctccggacgacattgcgtactcgtactgtcccgtactgctgtttttagtgattgtcacgggaagcctgttggacaccacaataatgttaccccctgaagacgaggtcagttgcgccttagcgttatccgtagtcatagttctatgtcttaataagtctgtatgtgagtacctagtttgttagcctgctttgttgcttacttagctgcgtgcttgttcaagaagaaactgacagaaactcaattgacaagataagactaccaagttaatcaatctctaccacccggctgtacgccttaatctctctctatatatacatactcacaataatacatgtgtcttagaacctcagtgcagtttgtccatggcgcccccctgagagcccctgccctgacctgcccagcggggtgacccctatcagcctgcggatgagggcccagggggctccctctccctggcgcgctggcactctaggcccgatccctcgtcaatccccttataaacagcgctgacgtgcttggactttgttccttgttcttttgttctttgttctggtgcagatggaacagaacaatcgcaacaagagcacgaagatatggctatcacccctgacaaacagaagaaagaacaacagcatcaaccacagaacggaccgctcgactatgctcacatatgcaagtgtattgcaatgttctttgtcgttgcgggcgtggtgctgatgttcttcgagaccgggttggacccagaacaaaaagagcaaatcaagcgtctccaccagttggacggcattcctcacgcttgatgtgcccagggtgatgtgttccttgatctttttcttttttttttttcaattacggattatgcatatataggtgggtatacgtacgtaaaaaaacaaaaacacacatgtagacatctatatacgtttaaaaaagctttagattcagatctttgggttttacaaaaaaaaaacggacaaaataaaaaaagcctttttcttcagcaaccgtcctcttagattagagattcttcttggctggcgtccttcttcttaccggagcttcttgtgtcgggatcttcttcatcttcgtcggcatcgtctctggctctatcgtaaaattcatcaagaatctttggggagattctattcaacatctccttagggtagattcttagcaaactccatgcctggtccaaactttcgaaaacggttctgtcctcgtaggcgccttgtgtgataaaggtcttttcgaatttttccaaaaattccaaagataacttatcttcgatggataacgcctcttcaccgacaacggccttcatagcagcagcgtccttaccgatggcgtacttggcatacaattggttagaaacgtcaccgtggtcctttctggtcataccttcaccgatggcagatttcatcaatctactcaacgaaggcaagacgttgattggtgggtagatacccttgttatgtaattgacggtcaacgaagatttgaccctcggtaatataaccggtcaaatccggaattggatgcgtaatatcatcgttaggcattgtcaagataggtatttgagtgatggacccgttacgaccctctactctacctgctctttcataaattgtggacaaatctgtatacatgtaaccaggataacctcttctacctggaacttcttctctagcagcggaaacttctctaagagcatcagcatacgatgacatatcggtcaagatggtcaacacatgacgttccgtttggtaagcaaggtattcagcggtggtcaaggccaatcttggagtgataattctttcaatggtagggtcattagccaagttcaaaaataatgaagttctttccaaagacccattttcttcgaaatcctgtttgaaaaatctagcggtttccaagttgacacccatggcagcaaaaacgatggagaaattttcttcatgaccatcatgaacatccttggtaggtctcaccaaaccagcctgtctacaaatttgtgctgcaatttcgttgtgtggtaaacctgatgcggagaaaattgggatcttttgacctctggcaatggagttcattgtgtcaatagcagaaacaccagtagaaatcatttcttctggataaatacgagcatatgggttgataggagaaccgttaatgtccaagtaatcctctgcgaaaactttaggaccgttgtcaatgggtctaccagaaccgtcaaaaattctacccaacatgtcttcagacacaggaattctcaaactctcaccagtgaattccacggtagtcttcttgacatcaataccagatgtaccttcaaacacttgcacaatggctctatctcctctaatttccaaaacttgaccttgtctcacggttccatctggcaatgtcaaattaacaatttcgttgtaacgtgggaacttgaccttttccaaaatgactaatggaccgttcacaccactgaccgtattatagttcaatctaggcttcacattgaaaccttgttcgacggctttcttatttatggcaaacaactccttatcagacaaaaccattcctgcaatatttattttcgcttgatgtactgtctactcttacaatcgcaatcctgtcaacaatggttgtctatctgtattaaaatcatttagtcctttatctcttatccttttctttcaacggggtgaaaaaaaaaaaaaaaaaaacaactaaaaaactgagttggttcttacccgaatgcttattacactggctgctattgtttatgactgactacatgcaactttatacacacggcaggaaaaaaagtgcgcactctagcctaccacgtaccatcggtcatgaggtcctgtgactgttggaggtggtgcggtccgccttgcaggatgtcctctttgtggattattcatgttatccaaaaccatcgagtacaacatcccaaaagtccaatatagcgagacggacctacacttcatcttgttccgtttcaccatattatagaacagcccatccacatcgtactggtccagtagccatgggatatccatgggtgttgaaggtacgagtttcaaatgtctacatatctgtaaaatatttatgataagcttgatcaacctttgtactactgtctgtatgctatcggaaaactcaaacatgggttgttcacagattttatttgtgtagggaagtttaatcataagaatgtctgagaagaagctaatatacttccacatgatgttgatggaatcgtttgttatagcaagaggtaaaatacggaagtttttcaaagatattagtggctgaaaagctatagcgaaaggtatttggaaattatcttgcagcttctggatcacaaaccaattatttagtagattgagcttgtaatctctagccgattcacaaatcttcgatacttgtgccagcttattttttgcatcactaatttccacttgctctcttaatttgtccgtaccagtacccaccttataacatttataattgtcaatttctactttcaattcgctgatgtgattccttttactataaatccgctcatttagctgttctatcctgtgcctaatcaggttattattctttttcattcgtaaaacatctaacttcatgagactattcatcaggggatctttctttttctccatcctcttgatatctaactggtcatagttcatggcctcgtttaatatttgttcgactttcccgttaagttctttattctcatcctttaataaaattaaatctagttttagcttcagtagcagacttgggctcgtattgatacaatgtgcacagtacactacatgcgctctatggtggcaaattgggcaatgcatgtcatactaggattctagtttttaacttttacttccctttttctctactcgttatccttctaatcacttttgtatttggtcctttcccttaattttcagcgaggaaaaaagtgcttattatcattaaaatacaaataaataaatagttttttaactagacgtaaggaaaacaattacacgtattatttaatagtacaaagaaaaaaaaagtcaatacatattcatcattggcattgcttatatattttcggcctttaatttttttcttatcaaaattccactcttgaaatttattatccaatccaccatatcttgatcgttagcggctttaaaagataacctttcatcaaatgtaattagcgcaaaattagtgtcgtcatttttcatcttcgaattattatcaagttcaatacaatcgataattttatccaatttaatgcttttctttaacttcccagtcttgaaagagtataaattgaacgaagtattagtcaattccacattgaacttttgccatttagccctattgaacagtttcttctttttcacttttgtgtaaagaatcccagaacaaacctggtgctctgcatttcttggatcgaacatcctataaaattctttatcttcacgagacagttgctcatccatcgtcaaactgcaagaatgcttgctgctagaaggacccgccttttcgtcaactacaattaaatcatcatcatcctcttcttcatcataatcactacctgtagtgacactttcgttgccactaggactagagaggaatttttcaagggcaattttccaattatgcatcagttccataccaaccttctcattttgccctcgtggaaatttgaatattaaatccttggatggagtataaacagttaatataccatcgagctcgcttatcttaaaattaagtatgtcaaatctcggtatgacacttatagcctctctttcatcccgagttttgtaataggcaaattggtttttcctcaagacacaccaatattgatggtctgttgtccgaggccaccataaatgacgatggtgatgatggtgatgatggtaaccctgcggtgcaccatcagcagctccattgttacctgaactggattgagctgtcggcgttttattttgagacgttgatggcttcttgatgagattcgatgcgatcaaaatttcatgctgacttgacggagcagtcgcacctgctatcattggtcttatgaaatttaccaaggcaaaattagcgtaattatttatggttaattcacctactggctactattgcgtaccacattttggcctgttcgtttaatttcagccacattatagtagagaaaaaaccgttgtgagtgaccgaaagtgaaaaatatggattcgtgtctataaaaccttagaggcatctatttacttttgttctattatctaaatgaatcctatatatatactcccttgtgtcggcatattctaggattgggccccgtgaacaaccatactatttccctttttcttatgagtggaggaaacagttcttgtaacaccgggaggcactgagattgtgggagatgtacttggatcgttattatgcgttacatttgttttactactgctcgagcttggttttcttactgaggcagttcttttaacaccaggcaaaaccggggatgcagattttggaatagaacccgatgacagcaaaggcgacgcagtatagaaacttcttcttttattgttactgctattaccattggaggatgaatcgtttgtgttcggcgtctttcttaatttgaccatcttaataggaagcatatcctgtgcattattgctactcaaagcgtcagcgttgttgctttccacctgggtttgtacattcttcttcaaggtttgtactaccgcgcctttattactaatcttctcatcgtttcttttcaagacgtctttcaaatccatcttttcagcaaaagttgatatcagattttcgttcgtctggtacagatttagccagctttgtagatttaactcatctaaagagtgagtgattatcttgcttaattttgaatccttttctgtttccagagatttcaaatctttcacagagtcattgaatttatttaaattcaattctatatctgaatttgaactagtatctgaaccataatttaaattttgattacttaactctaactccaacaaaccgattttttcatttaatttggaaatttcatcagaatagtggtctctgtaaagattttgtgactccaataatgaattatagttaacttccatattttgcaatttttcagagcaagattgttcaatggcactagaatttttcgccaatttactcaattgatccattttctccttttgttcattgtaacggttactcaattcgctataatctttctctagctcttttagcttcttgttctttctttcaaatatcgagttgagattttcgttctcgttcttcagcagatttaaattttccagtagttttgattctttggattgtgctaattccaatttactcaataaattttgagattgcgtagtcaattgtagatttgtttttgtcagcatatcaatctggtcatgcagtgattcaatgactctcgaagatgaggcattttggctggaggtatttctatcttttgtgggggaactttccaagtttgccataaaaatattatggtgaggtgccaacttgcttgaagaagtctgggtattatcctggtccgacatcttacacaaaagtagtgtcgttgaaccttggcgtgcttgatagacgagctaacgtttggtaaccccttcagactgctgctactcatggcaacaaatcaataaacaaaatgcaatagtagttagtaatgaagctctcgcccgaacaaaagacgaaacgagcgggtaactatttagcctattttattgcgatgacaataatatgtagtagcaatagggaaatagtttcatttgacgtggaaccaaaaatacattctaaatcgtacaactattaaattgatatatgaaagacggatatgagactacactatattacggtttttgatccatcaagatctaccaacgaaaatgacactttcaagcagttgctgctgttccattattttggcactactgattcaataccctctttaaacgaaaaactgtccatcataggagtaatacagggcatttggtcacttacgagttcatgcgtaaacaaggacggcgaagatttagagaaaattattgagctgaacaatgatattattttttgtattaaggtggaatcaagatttttcatcagtctagcaatttcgaatatcagcgacgatcagagtgccatacctttacagtatctcagtgcttacttatggcttagttacaggttcttcaagctactcaatgggtcattcagcggatttaacaaggacttccgcaaactcacggatttgttgaacgaattcgttattccgttctggaatgatatttatttgaatctagaaactgtaacgaatagatcatttactgtaatgtggcctggtttttataaaagggcaaattttcaacattcctcttataatcctggagaaaaaaataatgtcgaagagtcatgggacgctataatcttgcagaatattcttttagataaaaagagttatctaggactaaaggacattttggtttaccacctaccaaagcgcaccaaagcggctaatagggagtctatgggaacaaaaacttatggactagtaaggaactttaccagtgacctgaacacattaccagatatctcaaattggctatatcatttgcactgcacctatggtgaaatatcaagtcatatattaacaggaaatgtccattttaaagaggagctacaagtagaagaagaacaagagcgaagtcgtgatacaaacggaagagacgaagaggaatcacaggagcaacagcgacgggagcaccaagagactacgcaaaacaatacaagcgaactctctctatcggaaagagtgatacacaacgtaacactccccatttcttttgcatacgacgctatacatgaagtgagtaccacgactggtgtttcgggtagcttatccatgataatggactatgtaccgaagccccattggccgttcatttcatcctctaacaaaagtgccgacaaaaataattactcaaatagcaatgataacgcaaattcgaatgccccactgatggcgcaatcagaggctgttggagggacgataggcaactcgagatttggtttcctaatttccccattgaattcagacctgttgccatcatcataccaagccctgaaactgaatttgaactttgaaaactccaaagacaaggaggatttttataattgcctattttggtactttgatgattttttaattgtaattgtctgtgatccggacttcaacaagatttgtgaaagagactatctaaaggacttgagcttccaattgtgtcagagtatggaatgcctaaacaatgagattttaaactctcaaaattgcgataacgtggaatcctttgcttatgtgatcagagataacgtcaccaaagaaatcgactcgtccgttccatttgggtctccaaaatttacttcggatgaaagcatttcaactttacaactagcaattaacggtatagatcagttcattaacgataattcaaattccctatcgcttgctaattggaatccaataactattatgggtggctcaaatgctatcagcaaaaaaaatactacagaaggatttggaaacggggtaaacgataagactcaaaaattcaaaagaaaatatctgaatttcttgaatttaatgagcgcagaaaagttatgggacttacaggttgacgtcttacagttcttgactagtttacagaactcaaagagagacccagattattttcaggaggagaggttattaaaattgaacaatggtgttttatgctatatcaaagaaaacaattcaaacttaattattattattaaaaactggtttcaaaataacggcacgtcaaaggctgcaaaacaaaggaaccgttttagttcagattcctctaagggaagttcattgtttcaaagtttaggtcgtgacgtgactgactggtgggaatccagggaaatttaaaaatgtaacgtttagcatttgatagacatagaataaaaataagtaactataaaaaaaggaaaaaaaaaattgggcaaaatagggatcatattataactatttatatacagattcgaaatatgaagaagagactatgaaaggtgggtgaatatcaatattaaataaaaatcaaacaatgattgaaaaaacggtaaaagatcataaaaagccctccaggtaatatgtcaataagtaaatatactttatcgaaggaaagatcaaaaaaaaaaaaaaaaaaaaatgcaaacgaacatagccaaaggaccacaatattaatctgacaataaatttggaggcagtcaatgtaaatttgtgaatataacgacataattgcattatgctttgctataatattgaaatttttcgaaggagctttcaatctcatggttttcaatttctgttagctctttagaaaagtcaatttcatgtgggtttttgaagtgatctttaccacgtttccaaataaatttgtagcccacatatataccgatgttgataaacaccattaaatacgaaaacaaaaaatcttgtgtgttccataatttgggaaagaaaacggtgtagccctgtattaaaatcattgcggaacatgaaacaaggccgataatagcagtgtatggttgaccccacgaacggaatggcaacttgggtaacgaatcttgttggacgtggtaagcccttctgaaaaataaatagacgatacaaaggacgacaaaattaatcaattgagaggcagtaatcaagttaattaaccaattcaatacgaccgcactattagaattcagttgcaaaaggctcactaaagcccataccaaagatatggccacagagtaaatgggcacaccatgcctattgcatctagtgaagatttttggcgcgtagccatctaatgccataccataaaatgttctggatgagcaataagtgtaagcgttaccagcagaaaaggcggctgtaatcaaagctatattaacaatgtcaggtaatattctaattttcagattattcattgcaatgacataaggtgaagacccggcgccaggccttgcttcattaattgctgctgtcaagtcaggatcatttggcgaacaaacaatcccaacacacagacaactccctaaaaacaaaaatgttaatctcacaaacacctgcttaaacgccttgggtaatacttttcttggtcgtttgacctctcccgctaacatagaaatatactcgccaccagctatggtaaacgatgcctgaatcaagcaagcgagaaacccctggaagtagcccgaagacttccccacatcattgccatcgggaaagtatttcttgaatggactttcaccataattacgaaacccgtaacgatcatgttcaggatttccacccaacatggtaatgaacgtgaatgtaaataggccgagtgcaaggataattttgaaagaagccaaccaaaattccatttcaccgtaatatttgactgcacaaatggaaataagcagatacaaaactacttgaacggcgagcggaataccagctgaataatcatctctccaataatgtataattgtattaacagaaacaatctcgaaagggatctgtacgcattcaagaaaccagaaattccagctagccatgacagccaatgaatcgtcaacgcacttcgttgctaatctcaaaaagggggaacttacagggaaaaagcagaccatttccgctgtagacacagtaatgcaaagtattggaacacaccaaagagcaaatgccaataataaagaggcgggccctccacggtataaagcttttccgatcgccacgaatagcgccgtaccaatgacaccggaaatagcaatcaactggacgtgcctgttttctagtttacgtcgagtttctgtgaaatatagcaggtaagtccttgagtcatcatcaatagaagaccctctatcctcatgttcatccacgtgaacatcgcccgcttcgggtatcgtgtttatgtgacccactgacccagaaggttccaaccatccctcactaggttcgatactctttattcgagtggttattgtcttgtatttattcttatcgtactcaaaatcaccgtcattttcgtagtcgatggtcatacgttcctttgtcatgcttggcaaaagttatggaagcaaaatgtaagtgcagcttaggggggacaaggctgaaggaaaactattgtttttaattaccacctattagtatcttaaagcaaaggagctaaccgagataatatcaatacgaagtatggtgaactaacactacccttactcctgaattacataaattaaagcaggcaacatgtcgagatccatttaccattgaagagttccaaaaaaagggttctttttttatacatgtagttttacggtgcggcgccgacaccccgctcgatcgatgacgctgacttgtggtactcaggacgtatggatagttatttgttgccgcagtatatagtatacaatgcagaattcacagaggcagggaaaaggctctgccacagacattatgtagcgtggaaacactagtcttgactctgacatgaacttctggaacatcttcctcgaggtcttcgtgccttggcaattcgttagagggttcaagcgctttagtagatttgagatcaaacataggcttattgatagaatctaaatggtccggtttggcggtttcgctgagtccgtgaatatcttgtacgctttgccaaccagtttctagattggataggaatccctgttcttcttcgttttcaatgtcttggtcaagatcaatttgattatctagcttttgattggtagtcgctgaataatgtcgattatgggctaaagttttagtgtcatctgtaactatagacctcggaatagtcatgcttgcagcagttaccgccgaagtgtaatttgacaacataaggtatatgaaactctccaaagaccattcataccaaactttttgttctgtatcggagtgtatccgagacatcagcacagaaagttcggagtcatctataaaggatattggttgcttcaaaggaaagataattggagaccacgaggtcatatttggtgtatggtcacatttcttgattagattttcttctcgtctggtattcatcaacgtttcttcgctaaattttaaacggactgtgctgtcattgggcaaagttgacaagaatatattgttatataagtttgccgagaagaatccgataaagccatggatttcgccgcggtgctttatcttgaactcatttaatgaactttgagaaaattcaactgtaaaatcatcttcgtcttggacagtatctttttgggccatgggatgctcgaaccgccacacttcatttacccttgaggataatatacagtatggcactctatggactatccagggcgcctccaaagagcgatttgtttgtgagagtttttggtagaataatggtgacgaaatgggtgctatgtatgaagagtatgacctcggtatgaaaattgtgtcattgtgggaatgatatttttcaatagaccagagacattctggtgataattcattgcaaccgaacgaacccagcagttcacttatgcacagatctatctgaatacgcttttccgacggctcgttgatttgccatttggtcatatcctccttgattaatttcactctattatcccaacagtcgaaatttcttttttgcaagtacagatatgcctgtggatttttttcaatggcaattatagaaaccttactatccataaacaacattgatattatcttaaaagttcgatccactaaaggtcctcttcccgcaccggctactaggatcaccaacggtctcttggcactcgctcgaggagcaagatcttgaagcgcctctaatatggcagattcgtaaagatcgtacttcaccaaatctttttcaaaagtcaaatatgtggaatttaataaattatctgaatgaggtttcagaggcggcattatccgagagtcctcttggagcaaaaattggtgattactattggaatttaatactttgtcgccctttttcaataagtagtttatatattccaaataggcagattctccgcccttaacattattggcatatttctccatcccatgcaatatcacgcataattcattacccaaaatttgtgaatctccattaaccttttggaactttaaaatcaaattctggttaaacttgtgtaaaacgggataatcgtactgattactggcaaagatggatgaagataccaaaagacacgagacgggttcggctaaccatctattcagcacatacgaaggagtcctggttcttggcaaagccaaagagatagtcaaagagggatgatattcgcattgtttccgcacggtattccacagttcccaagtggccaatggatcgctgtcttcgtaaagtggcagagaaatggatatggttaacgcaggcgcagcaaagacgatgcgattttgcaggagcctgtaaatcatctgtccatacaattgcaggttggacaggtcccgtggaggcgccaatattagcttattgattccaacaaacctcgcgtacttacattcgtttagaaggacctttaagccaagatctcttacatttggatcgcgactctccagctccagccaagaggataacagccctatgtaagacggcgtatcgtcattgtctagcttcttgacgttgaacgggggtatacagatatcctgcaactgcggttcaggaatttgaagcggtttccagttctgtatggattgtctttggaaatctttgaaaacttgcccaactatttccttatatcttggcgttgttataggaagcaaaacgtaatcatagttactaggcagttctggtgaatgactagagacattttctaggaaacgtgactttttgctgtgctgtttatgattaaagcctggtttgacaccaacaaatacgttgctatgcatatgcaaactgaaccctttgtatatataaaaattatatgtataaaagaagaggaacgtccgcacaattccacacacacacacacacacacgctttcacacacgcaatttgaaatagctcctatagggcttgggaataggatcacaagtcactcgaaatataccattttttctatcacacatacacattgtataaagccatttgtttcaaaaaaatataaaaacactgcgcagcgtgctgtttcgggttccatttgtgattgtttatttttcttttggtttagctcagtgcaaaacgagggctcgaagaattttcagataaaacagtactcgagccctgagatctgttttagggtctaaaaggcgggttataaaaatatgtcaggtgatttttttttctcgtggtatgagataaataaagaatggagcttttatgcatgaaaggacagcggatggcagtagagcagacatcagtagcattcattacaactctgtcgtaagttcttggaactgctggccgcgttggatacaactagattgacacgcacttactctcgtcttacagtactatgtaccatcactatcacgccttccaaggcagaaagcttactgaccaagaaagagcacgcgtgttggagtttcaagattccattcactattctccgcggtactcagacgataactatgagtacaggcatgtgatgttacctaaggccatgctaaaagttatcccatctgattacttcaattcggaagtggggaccctgcgtatattaacagaagacgaatggagaggcctcggcatcacacagtctttggggtgggaacattatgaatgccatgcgccagaaccacacattttgctattcaaaaggccgctgaactacgaggccgagctgagggcagcgaccgctgctgctcaacagcaacagcaacagcagcaacagcagcaacaacaacaacagcaacatcaaacacaatcgatttcgaacgatatgcaagttccaccccaaatctcctagctttgatatactctaattactgaaattgaattccttttcaaggctccataactatatggagcatactatgtacttatcataataaagaataaacaaacaagcaaacaaaaaaaaaaaaaactatggatcatagttttcaccaacaagcattagaatacaaataaaatttatatagtgaatatccttcaaataaatttcttctttcccttataaatcaaatagatggaacgcacgctccaaaactagtcaactagaaaaaaatacccgccgacggacaattttgaagagagatgattaatgaagacaaagtgaggctggacaacaagaacgacatacaccgcgtaaaggcccacaagactgcatggaatcacacgtcaaatatcttgacgaattgatattggcaataaaagacctgaactcgggggtggattcaaaggtgcagattaaaaaagtgcccacggatccatcttcttctcaggagtacgccaagagtttaaagatcctgaacaccctcataagaaacctaaaagatcaaagaaggaacaatatcatgaaaaatgatactatattttcgaaaacagtttccgcccttgccttattgttggagtacaaccccttcttgcttgttatgaaggattccaacgggaactttgagatacaaaggctgatagatgatttcctcaacatatccgttctgaactatgataattaccacagaatatggtttatgaggcgaaaattaggcagctggtgcaaagcatgtgtcgaattttacggaaaacctgctaagtttcagcttactgcacattttgagaacaccatgaatctttacgaacaggccttgactgaagtcttgttgggcaagactgagcttctcaaattttatgacaccttgaagggtctatacattcttttatactggttcacttcggagtatagtacttttgggaactctatagcattcttagattcttctttggggttcacgaaatttgactttaacttccaacgattaatcaggattgttctttacgtctttgattcctgcgaactagcagcactagaatatgccgaaatccaactcaaatatatttctctagttgtggactatgtttgcaatagaacaatttccacagccctggatgccccagcgttagtttgttgtgaacaattaaagtttgtattgactactatgcatcattttttggataacaagtatgggctcttggataatgaccccactatggccaaaggaattcttcgactatattctctttgcatttctaacgatttctcaaaatgctttgtagaccacttcccaattgaccagtgggcagatttttcacaaagtgaacattttccgttcacgcagttgactaataaagctctctcgattgtatattttgatttgaaaagaaggtccctacctgttgaagctttaaagtacgataataagttcaacatctgggtataccaatcggagccggactcgagcttgaaaaatgtcacttctccctttgatgatcgatataagcagctggaaaagctaaggttgctagtactaaagaagtttaacaagacagaaagaggaactttgctcaaataccgcgtgaaccagctaagtcctggattttttcaaagagctggaaacgatttcaagctaattttaaatgaagcatctgtatccattcaaacttgtttcaagacaaacaatataacaaggctaacatcatggactgtaattctcggacgtctagcctgtctagaatcagagaagttttccggcactctgccaaattccacaaaggatatggataattggtatgtttgtcatttatgcgatattgagaaaactggcaaccctttcgtgcgaataaatccaaatagaccagaggctgcgggtaaatcagaaatcttcaggatacttcattcaaactttctatctcacccaaatatagatgaatttagcgaatctttgttaagtggcatcttattttctctacataggatattttcacactttcaacctccaaaacttacagatggaaacggtcaaatcaataagagctttaaactggtacaaaagtgctttatgaattctaacagatacctacgtttattaagtactagaattatacctttattcaatatatcagactctcataattccgaagatgaacacactgccacgctgataaagtttctacaatctcaaaaattgccagtggtgaaagaaaatttagtcattgcttggacacaattaacattgacgacttctaatgatgtatttgatacactacttttgaaactgattgatattttcaattctgatgattatagtttacgaataatgatgactttgcaaattaaaaatatggccaaaattttaaagaaaacaccatatcaattactatcgcctattttacctgtattactaagacagttgggaaaaaacctcgtggaaagaaaagttggctttcaaaatttaatagaattattgggatattcttcaaaaacaattctcgatattttccagagatatatcatcccttatgcaattattcaatataagagcgatgtgctaagtgaaattgctaagattatgtgtgatggcgatacaagtttaattaaccaaatgaaggttaatttactgaaaaaaaacagtaggcaaatatttgccgtagctttggtaaaacacggattattttctttggatatcttggaaaccctttttttaaatagggctccaacttttgacaaaggatatataactgcataccttcccgattataaaactttagctgaaataacgaagctctacaaaaacagcgttactaaagatgcaagtgacagcgagaatgctaatatgattttatgctctttgcgatttttaatcaccaattttgaaaaagacaaaaggcatggttcgaagtacaaaaatatcaataactggacggatgatcaggaacaagcgttccaaaagaaactacaggataatatcttaggtattttccaagttttttcgagtgacatacatgatgttgaaggccgcaccacttactacgaaaagttaagggttatcaatggcatttcttttcttatcatatatgcccccaaaaaatcaataatttccgcattagcccagattagtatttgtttgcaaacaggacttgggcttaaggaagttcgatacgaggcctttagatgttggcatctgttagttcgccatctaaatgatgaagaactctctactgttatagatagcttaattgcattcatacttcaaaagtggtctgagttcaacggaaaacttcgaaatatagtgtacagtatactggataccttaatcaaagagaaatcggacctgattttgaaattaaaaccttacactactttggctttagtaggcaagcctgaattaggtattttagctcgtgatggccaatttgcaagaatggtgaataaaataagaagtaccacggaccttatacccatatttgctaataacttgaaaagtagtaacaagtatgtcataaaccaaaatttagacgatatagaggtatatcttcggagaaagcagacagaaagatcgattgattttacaccaaagaaggttgggcaaacttctgatataacattagttttgggtgctttattagacacttctcataagtttagaaatttagacaaggacctatgcgagaagtgcgccaaatgtatcagtatgattggtgttttagacgttacaaagcatgagtttaaaagaacaacatattcagaaaacgaagtttatgatttgaatgatagtgttcaaactattaagttcttgatatgggtcataaatgatatcctcgttcctgcgttttggcaaagtgagaatcccagcaagcaattgtttgttgcccttgtcatacaggaatcattaaaatattgcgggctaagttcagagtcatgggatatgaaccataaagaattatatccaaatgaagccaaactatgggaaaagtttaactctgtctccaagacaaccatctatccgcttttatcttccttgtatcttgcgcaatcatggaaagaatatgtcccgctaaaatatccttctaataacttcaaggaaggatacaaaatttgggtgaaaaggtttacattggatttattgaaaacaggtacaacagaaaatcatccattacacgtgttttcctctttgattagggaagatgatggctcactatcaaattttttgctaccttatatttctctggacattattatcaaggcagaaaaaggaactccatacgctgatattttaaacgggattattattgaatttgacagcattttcacgtgcaatctggaaggaatgaataacttgcaagtggattcgttaagaatgtgctatgaatccatcttcagagttttcgaatattgcaaaaaatgggcaactgagtttaaacaaaattacagtaaactacacggcacttttatcattaaagatacgaaaacaactaacatgcttttgagaatagatgagtttttgcgaacaaccccttcagatttgctagctcaacgctccttagagacggattcttttgaaaggtctgctctataccttgaacagtgctatcgacagaatcctcacgataagaaccaaaatggacaactactgaaaaatttacaaatcacatacgaagaaataggagacattgactcactcgatggtgtactgagaacctttgctacaggaaacttggtttctaaaattgaagaattgcaatattctgaaaactggaaactcgcacaagactgctttaatgtcctcggcaaattttcagatgaccccaaaactacaaccaggatgctaaagtctatgtatgaccaccaattgtattctcaaataatatcgaactcttcgttccattcttcagacggaaaaatttctttgtctccagatgtgaaggaatggtacagcataggtcttgaagctgcaaatctagaaggcaatgttcaaactttgaaaaattgggtagaacaaatagagagtttaagaaatattgacgatagagaagtacttttgcagtacaatattgcgaaagctttaattgccatctcaaacgaggatccattaaggactcaaaaatacatccacaattcctttaggcttatcggaacaaattttataacgtcatctaaagagacgacgctgctaaagaaacagaatttattgatgaaattacacagtttatatgacctcagttttttatcttctgcgaaagataagtttgaatacaaaagtaacactaccatactcgattatcgaatggaacgtattggggctgacttcgtgccaaatcattacatattgtcaatgagaaagtcatttgaccaattgaaaatgaatgaacaagcagacgctgacttaggaaaaacattcttcactttagcccaattggcgagaaacaacgctaggctagatatagcctccgaatcattaatgcattgtttggaaaggcggttgcctcaggcagagttggagtttgctgaaatactatggaagcaaggtgagaatgatagagccttaaagatagtgcaagaaatacatgaaaagtatcaagaaaattcctcggttaatgctcgcgatcgtgccgccgtgctattaaagtttactgaatggttagacctttcgaacaattcagcgtccgaacaaattattaaacaatatcaggatatttttcagattgattctaaatgggataaaccatattactctattggcttatactatagtagactacttgagcgcaaaaaagcagagggttatattactaatggtcgttttgagtacagggcaatatcttactttttattggcatttgaaaagaacactgctaaagtaagagaaaatttgcccaaagttatcacgttttggctagatattgcggccgcatcaatttctgaagctcctggaaacagaaaggaaatgctgagtaaggctacggaagatatatgtagtcatgttgaagaagcgctgcagcattgtcccacttatatttggtactttgttttgactcagttgttatctaggttattacattctcatcaatcatcggcccagataataatgcacatactgctaagtttggctgttgaatacccctctcatattttatggtatatcacagcccttgtaaattccaattcttcaaaaagagttcttcgtggtaagcatattttagaaaagtatagacaacattcgcaaaatcctcatgatctagtttctagtgcattggatttaacgaaagcattaactcgtgtctgtttgcaagatgtcaaaagcattacaagtagatcaggcaaatctttagaaaaagacttcaaatttgacatgaacgtggccccatctgcaatggttgttccagtaagaaaaaatttagacatcatttcaccactagagtctaactcaatgaggggctatcaaccatttaggccggttgtttctataattagattcggatcatcttataaagtgttttcttcattaaagaagccaaaacaattgaacataataggttcagatggcaacatttatgggatcatgtgtaagaaggaagatgtccgacaagataaccaatatatgcagttcgccacaacaatggattttcttctgagtaaggacatagcttcaagaaaaagaagcctgggcataaatatttactccgtactatctcttcgagaagactgtgggatattggaaatggtaccgaatgttgtaactttaagatctattctttctacaaagtacgaaagtctgaaaattaagtatagcctgaaaagtctacatgataggtggcagcacaccgcagtagatggaaaactcgagttttacatggaacaggtagataaatttcctccaatcttgtaccaatggtttttagaaaactttcctgatccaatcaattggttcaacgccaggaatacgtatgccagatcttacgccgtcatggcaatggttggccatatattaggtctaggtgataggcactgtgaaaacatattactagatatacagacgggtaaagttcttcatgtagacttcgactgtttatttgagaaaggcaaaaggttacctgtcccagaaattgttcccttcagactaacaccaaatttattggatgcgttgggcataattgggacagaaggaacatttaagaagtctagtgaagtcacgttggctttaatgagaaaaaatgaagtagcgttgatgaatgtgatcgaaacaattatgtacgatagaaacatggaccactcaattcaaaaagcgctaaaggtcttaagaaacaaaatccgcggtatagatccgcaggatggcctggtattgagtgttgctggccaaacagaaacattgatccaagaagcaacatcagaagacaatctaagcaagatgtatattggttggcttccattttggtaacgactttccaccattttcggcaacagacgaacttcctcttgatctaaccatcactgcaggtgcttttctccggcggagttaatagatacttatccccgcttcatgtcatactatctctcttaacagggatgttgacaccatataagttaacataacatatacgtacgtaataatattaaggactatctcgcatttcaaaagagaaacaacctaatcaagccttattataagagcaaattattcaaaaaaagtctacggagaaaattattatggtggttttagacaagaagttattggaaagattgacttctcgtaaggttcccttagaagagctcgaagatatggaaaaacgatgctttttgtctacttttacatatcaagatgcctttgatttggggacttacataagaaatgcagttaaagaaaatttccccgaaaaaccagttgcaattgatatctccttaccaaatgggcattgcttgtttcgcacagtgacctacggtggcagtgcattggacaatgatttttggatccagagaaagaagaagacagcgcttcgatttggtcattcaagtttctatatgggctgcaagaaaagtgacaaaacaccggaggaaaagttttttgtggactcaaaagaatacgctttccatggaggtgctgtcctaatacaatcggagagaagtgactacccctatgcctgcttaactataagtggattgaagcaggaagaagaccatttaatggcagtcagctctttaattgcatttgctaatgaaagtctagaagaagatttgaatttggattgagaatgtaggtagaagtaaaatagaggcttgaacaccatagaatattttttacccgttactagtataactgttatttagtcgtaagcttttcatatatatattgattgttttgcccttgaaaaaatacacagcaccaatgcagtcctgtttgttttagtgatctcttagcaatgtattttcaaggttgaaaatttaaacgatcactattttgattgcgtaagaaatgcggaagtaaaccatttattctccacttccacttcaattttcttcttgcttccaaaaaccaattcattgatttagagcccattgcatctttattaaaatgatgtttgattgacttatcattttctagcaattgcaactgcaatcgttctattagttccttagagaagctgtcctttttttttgatatttcctttttaaggtcgatcttgttatcttctatgtgcctatttattttttttggaacatctgtcgataaatgaaacggttctgctgaattctctagatcactaaaagtaccgctgcttagatttgattcatccatagatgattcgaactcgcagttctcaaagattttagcggcttcttcatatctaactgtgcattgctcacatacaatttctttatagtatcctgaatttaaaagtctcgagctaatttcatatagggccttttcgcagatgacacatttcctcagttgggaatgaacatttaattccgatagataaagatcatcgtaacttttattggaagatggaatattaaccaagttaaccaccatattttcaatggaatttggtatggaaatatcacttatttcaatttcctctttgataaaatctaaggggttgttactttcgtccctattttcttcagtattccttaatatatggggtatcagtgttagtgaattcggttcaaagctatttctattggtttccttattaatttcagaatatgaattttttactctcagcgggatatgattatctcttcttttacttagttttgatttcaaatctgaaatagataccattttttttgttgatttactttgggtatacggtatgtagtcttcaaccaggactagcggtggtatatcctgagaagtattttctgttagctcgtagttttttgtatctaaactcggcccataactgacgtacctattacgtttgttgttatgcactcgcagttcatttacaggattcaacctgggccgttttttattgttgttgtattcgttgtttccactgtcatcttcattagtttcgatattgcatggaggcgcaattggcaaagacgtaaagctcttgtcatcaattagatctaatttggaaacagattggtacaatttggatggaattttaggcttggcacctatacattgtgagcgacgctttcttacattcaataactgttggttctgattttcactttgactattgccttggtatggagaatttctctgcaatggttttgcctgcttcgaaggagtgctgttactatcgaagataaattccttcttttcaaattgccattgtaacatggagttattctctatatcctggacgactggaggagtcaagggcctggaaagtacggatcctgtagaaatatcactggcaattatactgagtttattgttggtgttgctattcatatttgagctggtattggacgaaagcaaggataatgagtttgtgtctactgactccaacaccctaggctggatttgatctttctccatcctttaattttaaccttttaattagtggttggatcaagttttcgagactattccaatctgtgacttgttggataaatagtttttgactcgtttagtataatccttttttctaaaagtgcttagagttctctaagatgttcttgtttacaatgtgagcgatttaggaaatttcctaaaaatggccgaggcggcgctagcattctacgaaaggtgagataacgcttcgttatcgaaaaatgtcaggggacaggggttatataagaacgaaaattgtcatcctgcattttttctttaaaacagctatacaaaaagtgataccgacatacaatgaagtatctaaacttagttttcgtgcttcagcttcttattagcatcaaatacgcctcattcggccgagccttttctctttttgaagatgataccacctttgccaatttggataaacagctaaagcttccacagaatacacagcaaacccttaaattggaccgtttgaatcacgatgatccgctgtttacaacttttatttcttctgtggacacagattacagtttgagacttagaacagtagatccttctaaactaggaattgacaccgtaaaacaatggtcgggttacatggactataaggattccaaacactttttttactggttttttgaaagtaggaacgatcctgctaacgacccaattattctttggttaaatggtggacctggttgttcctcgtttactgggttgctatttgaactaggcccctcatcaattggcgccgatatgaaaccaatccacaatccctattcttggaataataacgcttcaatgatcttcttagaacagccactcggagtcggcttttcctatggtgatgaaaaagtctcctctacaaaattagcaggcaaagatgcgtacattttcctggaattgttttttgaagcttttcctcatttacgctccaacgatttccacattgcaggcgaatcctatgcaggacattatatccctcaaattgcacatgagatcgttgtcaagaaccctgaaagaacgttcaatttaacttcagttatgattggtaatggtatcacagaccctttgattcaagcagattattatgaaccaatggcatgcgggaaagggggctatcaccctgttctctcatcagaagaatgtgagaaaatgagtaaagctgcaggtcgttgtcgtaggttgaacaagttatgttatgcttctaaatcaagtttaccatgcatagtcgccactgcttactgtgactctgcacttttggaaccgtacattaacacaggactcaacgtctatgacattagagggccctgtgaagataatagtactgatggtatgtgttatacaggtctccgctatgtcgaccagtatatgaattttcctgaagttcaagaaacgctagggtccgacgtgcataattattctggctgtgataatgacgtgttcaccggatttttgtttacgggcgatggaagtaaaccatttcaacaatatattgctgaattattaaatcacaacattccggtattaatatatgcgggtgataaggattatatttgtaattggctgggaaaccatgcttggtccaatgagttggaatggatcaataaacgtaggtatcagagaaggatgttaagaccatgggtcagtaaagaaacaggtgaagagttgggacaagtcaagaactatggccctttcacctttttgagaatatacgatgccggtcatatggtgccctatgatcaaccggaggcaagtttggaaatggtcaacagttggatttccggtaatcgtgctttttcggatctttccaccttggaaaatgctagttagtagtgctctaaaaatgtttcactcttaaccttgcaatcattatactttacacaaatctctacgtttcatttaatttaaaatctacaatccaacaaatataaaacaaaatataattataaggaaaaacgtatataatcactgcaatactctaatttaaaattaggagcacgacattcttgccagtatcattgttgctaatctttttctctcataaattgccacttgatgttcaccctctccttttaacttttctatatgttcctgatcaaaaatatccagaggcttcacaactgacaagcctctcttttttaaaagttcgaccatttcatcattaaattcctctaggtaattaaactcactgtgtgtaacaagcatcccaatcaattcaaaagagacagcaaccgcttcagatgattgttctagggttgataacctcctgaattcctttctagtcagcgtatagaacctgaatacacaaatagggttgactttgagcaaatacctcatcaatagagcaaaacggaatttacatggttcgtctgacataacacagctaaacaaaagtgctccttggtataagactatattagatttatctgagtctgaacttagccagttgatcaaagtaagtggcacttttagtgtattatttaaaggtaccagttcatcttcgaagccgacttcaagtaacaaggtagaaagttgttcaggacttaagaccaaatggagtaagaaaaggtaacaaagataatcggaggattttgggttggactttctttcgtaatatgtattcttgaaaagggcctgtagacaatctaatgcggctccttttacgacaggaatggataaaccgtttgcaatgaaacctaaaataatatgaggaaaattatcttcgttccatatgcatccattgtatgactctaacttagccaaaagcgtagcagcaaaatttctagattccattaattttttggctagcgatttgccatcgaatccaagttgaagatggaccgtgtacagtcgcttcaaacaatttaccatgaacaggagaccaccttcaaagagtaaaggatgaggggattcaacacatattgtagcaagccaaaatagctctttcattaattctgaagaaggatctaacccttcgacaattttgctgtaagtaaagacatgagctataatgatgaacatttgttcatcatccacaactggctctgcgaagaccttcatggtttcaactaaaagttctttacaaaggaaaagggacgtgtgcgacttactcattatacctagaatcatcatagctctcgcagagaagaacgaccgatggccaaaaatcgcatccatcaaatatttcttatattttgcctcccattgtgcaccctctgaaatagaaccatattccatcaatagcataatgtttttagtgaagagatctaatgttccgaatttactggagaaggaggaagcggcaaaatttggtaaaactctacctttttcttggctaaaaccggagataaagttcaacttttgacgtgcgaatgttgcacagacgatatccaaatttttcctattcctttcaggtaaggactcattgttggttaaagaatgacaaacattcatcaacaactcgtacaatgagactcttatttccgaaggaccgacatcaattaacagagacacagcgaaaagaatctccggtaaatacatctgggaaagtaagggtgattcaaagaaaattgacacactaatttttgataaaatagtaagctcagaccaactgtgtgcggaagcctcaactgctagagaaggtagaaaagatttgatcatatttattagcttctctattacctgacaagcaatctctgtcgttggaaaactggttagtattgacacagctttcatccagtctctgttttctgaatctctatccagcgcatgacttactatttcttcaactatcacgttcgtgagacgaccatccaatgccagtaaaaaccaaatctgttgaaggtaagctgtcgtgaaatttggctctttgaccgtcaacctgattaagctatagattatacgtgaaatcgcctctggtccctcttcgtcatttgccaaatatacatgttcatataagtttggtacccagtatgacaatgaacagacaaccgtaggaatatgttcttgaggaatcacgtcgttttcaaggccatccagcatatatttccatatatatggagttagttccgttgaagattctgaaaaagccttgaaaattagggccaagaacgtggtggtatcatcgggtacatatgtctctggggatttgtgaagccttgtcccaaaatctaaattaaatgcttcttgcgttgccacgagaaggttgtatgatatgtttttgacgagatcatcctcattgaataaacctacaaggatcaccaatgacaaatgtgatataatttcaccaacttctttaacattgcagtaagaagcattaactgctgaagaggatgttgaaaatgaaatatcgttcgaaaaatccgtaccaaagtcttcttccatctttaactgggcataataaaacattttcacaatttctaggtacttcggactgcaaaataccaacttttcttcattatcaagacttaacgtaaattccgaggaaacgcctgtggtgttagagacatcgactgaaattaaatttgatatcttgtaaacattgttgaatttgatgctgaatgtcctgtttgatacggtaaccttgtacaactgcggaatctcatgtaaaacttggaagtatttgtttcctatcttcaaggacacgggacaaaacttctttttttccttgtcataaagggtaatatcatgcaaagtaactcttacatctttcaaaacttccaaactcctaccactcaatcctaaggactttatcaaactttggtcagtattgctgttgatgaaacaacggggaattgtagtgaccaagtacggattttctacagtatatgatgaggcccattggtccataaatgatttgttgacgttgaagtaataacatcccatacaattacttgatgcttgctctggtatcaaactgaaaaatagagtagtcaatttttggaaattagccttacccccataaaaggtggtacaatcgataactacataatgtttagagcaccacattcttgcatatatctgcagaactttatagaccagtgagtccattacaaaattattgtactcgcaattggtaaaagttacgacaatgatttgtatgccatccaatgtcattgcttcatgtacaaatggcgcattatcctcttcttcttctttcatgtccacttttttgaaggcatagcgactcatgaattcatacaatgaaggatatttttcccgattctcgactacaaaaggaggaatttcattttttatttccatgctaggttgtcccaatacaccaagaattttgtcgttgagcataacagtatttttcaaaaagctgaactcccctggtaatttggattcattaataatttcttttcttatggtaaactcattgaggtaaaagaatttatgcaaaaatgagtagtcaaagcttattggtgtcggatcttctcttacattgacggtgaaattgttagtcggtatcttgcacaattcagacaaaaaattgaatattttatcactacaggttttcaaaaactcttcttttgaaactaagatatctttcttgaatatattttccctgccattagctaaactttgaataactttagctagtgtaataaagggctttctgtcatgggcgtgcgtaacaataatgatattttccgaatcaggactaactaaagcaggcccgataaacctcaagaaaacgaatgacccaacggcaatatatgcgtattctggaaaatttacactagcagcattgtaaattgttttacagatatcaactaattctattgggaaatcatcaatagaacttgtaattgcgtcaattaatcttgtcatgtacttctcaaataagtctaacatcttttcggagttttcggatcctggtttcatcttatcaatttcaaaagactccttgttatccactatcccttgcaaaacgggtctcaaagtttttatcaaatatttgttacctctagatctagtgtaaagtgacaaagcccttgttgcacaactatttcttctgagaatatcgtctgatcttgcggcccgtttgatttcttgtttaaggagctcagtaacaaggatatgagacgcatttctagtgtcaaaggcgtttaagaatccaccagcatataaatcaacatcagcaggagaacacgctaaacttccgaaaaatgctaatattgggttcttgattatatatttcaggaagtcgtctatagctagcattttatccatttcatgtttctcagggttaactggatagttggttactatgtcgatgaaaactcttaaaaaggcgattctgatatctttatttggagaataacccattggtaaagtgaattttaaagaaacgttgacattggcattagataagttcgttagcgctattattacattttcattaagtatactgatcttatgccttaatgaaactggaaactgattcaggtccgcgcttttctccagaccttttaacaaaatagtaaagtgattgccaaatgatactgtagaagatctgttccaatcttcttttgagcttgaaggcggtatttctaaaggaacattatgtgttaggtaagccaatgcttttgcagattcaatagaagtgtcgatatacaaaaaatcttcgtcccttttctgcaaatccatttcccttaatggtcttgacaggttttcaaaatcataatccttattaatagatagtttgaaccaaccaataactaacttcaaccatttattctttaaatggaaatgatttgaaatgcccaggttcttttcagagtgctcaaatgctctaaacattttcgacatttggataattcccttataatatttggaggacttgatggaaattttctccactatttcgatcaacttatcgaccgcatcaagcaagtccgtcgaaaagagtagcattatcttttcatcatcatccctctttagtatagttcttattataattattatctgctctagtaaaacaaacgatgaatcctcatgtgactttgaaagatcaattgacatcagttcatctattttcagtcctaggttgttaaacaataagttaaaagatagaggatgcaactcaatacttaatatatctctcgaattttctcttgttaatagatttggattattcaaccattgacattgttttgaaataaagaaattcatttttttcgttaactcgagtttaagacttttgtgcacctcataagcgggatttcgtgactcaaatgataagctgtctccttcattatctggagcgctcttgcttttttccaactcttgcatatcagacagaatacctgacatagaagctagaatgcctgccaagcttctaaaatctactagttcctcttgcgtaactgatttcgaacagctgaagtaaaaccacttcttgtaaatcacgtccattgaatccaaaaggattgagtcggatcctttgatataagttaaaatattatttcttagacgccgttgcaaagccactgatcctgaggcagtgaaattgtcctgggccatagcatctatgaaatcaatattgtaaatggaatattgatccaaagcgcctacgtatttttgataaaatctcaaggatcgtagaaattcacaacatgaaatttttattaagcgtggcgtatttccacgactgcagtataatgaaatgaaaattccacttcctacagcaccaactaataatggcagcgtcaacctctccgtcgtaattattgcctggactaggttgtgtttttctgctaaatttgataaataagaacggactcgttgaaatttaacaataatgtctagtagcatctctctcttcgcattttctaacttcaaatcaaacaatgatgaagcaaacaaagtaacggcatatgtacataacaaataatggtcattcagtactcttgggtcaagatcattatcaatgtcttcaaaagtagctatataacttaatgggatttcaataaaagcccgcgctgtaacttgtagtctttgattagaatccaatatagagacaaaaagtggttttataatatccgtaaaagtcttcgggaattctgtattagcatctgggcgtataaaccagttggtcattcttttgaaaatgctgaaaatgttcatcataatctttcttgcttcatcattgtcactcagtattactcttgaataagaaggctgtttcaattgtttatcatcagcaattttttttgttttgtttggttttggagatttgatgtttttcaaaatagttggggttgccgtaatcgaatgattagaagaaaatcctgcacttgacgagaggactgagagcggagaaggcaagtcactttgttgcaattgcggcggagaagaatatggactttgtcgtgatctttcagagtcgttcggtgaagcgtatctcttagtagtaggaaccccagataatctatgggctaacaagtttgcattattattttgttgtgcctccaacggattagtcaaaatgttagacaagctcaaatcagaagcacttgatctgttcgataaggttggtaagattgattgaatatcccaggtgcgcgtattggtgatattgcttcctgagttaattgataagggtgattgggaaagtgaagagactaacgaggcatccgatgagttatgaataatttcggttggctcagtgtaaacgcttgtggcagcatcaaaactgacatgatcatcattagaaagtgttcgcgcagcgtcaaattgatctaaaatatgcccatccaatatagaagcaataatcttggttacattatcgtcaaaataaggcgttgctttcaacaaaatatcagcaattatgcagaaaagtctctttaacacagaggaggttttttctgcaatatcctcatgaagttttttggtgcttactaggtgaaaaaataccctaaatccttcagtgtataacgatattttgggaaggtctatgtgattgagttctttttccagttgtaaatgtcttaaaaataaatcagaatccagctgtaaaccgcttgcaaaaaactctaattgtaaacgcctatgtgtaaggggattcctttcaacacaatgagaaataaaagtatttgcagtggcagaattccaattggtgccgacctctaaattttgacccaacaagttgtagaatctcttcgaaaaaataacagaagcaatatttgaatcgatttgggatatagaagacgtcattgtcattaagaatagaatggacctgatagagtcaatcaaggaaacatctgaaacgaactgtcccccattcaaatttctaatcaaatatgtcaaaaatttaacgttacgtttcctgccttgctgtaaagtaagtttttttaagccatgggtgaggtgcctgatacttgggtttttggatgctgagccccaacttgaagtattagagtccttcggattaatattcattatcggttccgaaatttttctatacgaatttgagttcatctcatcatatacttcactgtctaataaggtcagaaccaccaaaaaccttaatatggcagtatgggaggatagttctgatccggtatagttggaatacagctccataatattttccatatagtttaaagaagactgatcgttctgagactgagaattattaactcctgcatgcatatttgtatttgtcatcgatgcattagaatgctgagaagtatcccaaagaaacaaggagttactatcatctagattgagtgattttctactcgagttaaaggatgaaatgtcatctaaggaaaatatgcgttgtggaatattattaagattagcgctgttgttattgttattattgttgttagtattcatagtagagggcgtatctgcatctgttttggtagttgcagccgtagtcgatgtggaagtattcgcctgtcctagtgttgaagtgattggagataacggataccctaggatgttcgtgtttaagggtgaactcaatgatgccataggggaagtaggcgatgcatcattcccagtagaaaactgagacggagaaacattgccagaagcattcacactcgactgctttatcgacgtttttgatatagagtttggactattagtgttggtcgtctttgatgaagaagatgaatgatgaagatggtagtggtggtcattattgacatttgttaataatgatgatacactaaaagtggaataaacgtcatcgaataacagtgagactagttgggatatagacgttttatcagaattattcgaaccaccattatcagatgaagaagacggactattataatctgatgatattagattgttataaattttgacgtattcttttggccttgccattatccaaaataaaaaagctttggaagcataatataacaaaagcgaatgaaaaatggtcctcttcatgtaacttgacaggtgttgtagtatgtccagatatgctagcagattcttatcagtcaaatactcacaaccaaataaatccaagtggtttactacgcccaattcggttgaggtgtgtgatatcaataaaggtgcaacaacttttgttttgacacactttgtgaattcaacatgattggaagcagatatgaatctctggatataatctattgttaaatctattttctcggtatatgctggatagtttctcttttgtaaaaattcctgtgaatcgggtaaaatactcgattttgagatagtagcgctgccagaaagatggtgagacatgttctgtaaaacctttaaagttcttgtattgaacttcagcttagaaattttacatagtaacatcgtcgccaaagctggattgattctcgtgtgctttggcctagatgtatggaagtttggcctgtgacttgaaaatcccggtttgtaattatcgtttctaattttcttgaagtcattgttttgatcccagtaatactcaaaaacatcactcagtaatctcaaaagaaccaatatagaatgggcaatatcatctgtaatattgtcagacgtaatttcttcatcttgcacaatcaagtcaattaaacctaatgtgttttcgataatcgggttcaagtccttagtgatggctatattcaaaatgatggaccgacacgaattgaaaactgaatctgcctccacatcagcatatgttttcaaattagattctatgggaagaacaagtagaagcctatcaaaaaaaagatgcttggtcaaagagtattccattgggaaattttttttgtcttgcggatcgctttgattcattttagaaagagccttaatcttgttgtatgttatatgctgaagaagaatgttaagtttgaagctctatttgcagggcaaaagatgatcacttgactttatacgctttcgttaaatagcttaaccacgcgctgaaaactactatgagcccaatgccaataaaatgatcaaaggcgtaaatgaaaccggtactgtgtaataagcggaaaaaaaaaaaacagttaattgtttcaatcgtaatacaaagcgaaaacctttagtatattagttttatatgagcagtaactcttgttattctccttcgaacactgttcatttgctcatcttttacttaacgtttttacacatctttctatattgtatccctttatgaaaaacttccaggcggtgtcggctcgcttagagggtaataccaaaattgttcaacccagggccgtcgttaaccttgattcttttggaaaagctactcggctgcggtgaaactacctgcaattgatacaaacaatagtacaacttattactttgatggctattaagcattatgagcccgatagagccgaggaggttttgtaacagtgttttgtcgcagtatcttgagtgcgtcacacaggcttgtggcagaacaataaagatgtagccttgcggcttgagaaatttgaccatgcgatggcacattgcaccgcgatccctgtgatttttgacaaaatttagcactagagagcatgatatcaggtcgaatttgtcgttttcatttctcggtagcggtctttccataaaatcctgcttaataacgccttcatgttcctctaaatctatacgaaccacatttctaaaaagtgcacaacgggatatgcgatttccggagctcaatgaaccaatttctaatgccactgctccaggacaattttcaaatgaggacctgatccatttctcgagcaacttggacgtgtctcctcctcgttccttcaattgcccgttttgactggcaatttggtaagtttctagtcctcccaatttattaatctgattcattatgtaaccaagtaatgtgtacatcacagccaagtcagaagtatcctttgatttggattcatttttaattaatgagtgcagcctcagtagttgtgattccatagcatcattgaaggactgcgatttgccgtcttcatagtacttgcccagtcttacattacctttaatacttaacctgataattttgtcattcttctcctcgttggaatcatctaggttttccttaaggcataaaaacttgcatatcgattgacgcttattaattaaatggtggaatcttcttattatccttcttgtcttctgtggcttgattactctcgtcacgttacttcctacttgcttcctcttgcccgtaatactcttcgactttcttgaatgcattccgctgtattagtggtatcgctaagctgatacaagattgccatcaaggtcatggctagctcatcgatattataattgttatattttttttcacctcacaaacccgcctcaaggttagttagtccgtacttttctttttctctgaaaaacttttccagcgatgagcttataagaatttccatctaaaaaagttatattcgccaacctgcccatcattatcatcataacctcaggtagaaattctttagtcaaataccggcataatcagtttttccatcatgggtaagaaaagggctcctcaaaaaggaaaaacggtcacaaagccacaggagataattgtagatgaatccaaattgaactggaaaccagtagatattccggacactttagatgactttggtggattttatggcttggaagaaattgacggagtggacgttaaagtcgtggatggtaaagtaactttcgtcaccaaaaaagattcaaaagtgttaaaagatagcaataaggaaaaagtcggagatgatcaggaatctgtggaaaatgaatcagggtcagattcggagtccgagctccttgaattcaagaacttggacgatattaaagaaggagagttgagtgcagcatcttattcatcatccgacgaggatgagcaaggtaatattgagagttcaaagttaaccgatcccagtgaggatgtggatgaggatgtggatgaggatgttttgaaagaaaacgtctttaacaaagacattaatatcgatgatatttctcctgtaaatttacctgaatggacgaatcttgcacctctctcaatgactattttgcagagcttgcagaatttaaattttctcagacctacagaaattcaaaaaaagtctattccagttattatgcaaggcgtagacgtcatggggaaagcctctacaggttcaggtaaaactttagcctatggtattccaattgtagagaaactgatcagtaacttctctcagaaaaacaagaaaccaatatcgttaatctttactcctacaagagaactggcgcatcaagtcacagaccacttaaaaaagatctgtgagcctgttctagcgaaatctcagtactcgatattatctttgacaggtggactctctatccaaaaacaacaacgtctattaaagtacgataatagtggccaaattgtcatcgcaacaccaggtagatttttggaactgttggaaaaagacaacactttaatcaaaagattctcgaaagtaaatacgctaatccttgatgaggctgataggctgttacaagacggtcatttcgacgagttcgaaaaaatcattaaacatttattagtagaaagaaggaaaaacagagaaaactccgagggcagtagcaaaatttggcaaactttgatcttttctgcaacattctccatcgacttgtttgataagctatcttcttcccgtcaagttaaggatagaaggtttaaaaacaacgaagatgagctaaatgccgtaatacaacacttaatgagcaaaattcacttcaactcaaagccggttataatagatacaaatcctgagtcaaaagtgagctctcaaatcaaagaatccttaattgaatgtcctccattagaacgtgacctatactgctattactttttaaccatgttcccaggtacaactttgatcttttgtaatgccattgactccgtgaagaaattgaccgtatacttaaataacctaggcatcccagcttttcaaattcattcttccatgacacaaaagaaccgtttgaaaagcttagaaaggttcaagcaacaaagcgctaaacagaaaacaataaatcattcgaatccggattccgttcaactctcaacagtattgattgcaagtgatgttgctgctagaggtttagatattccgggtgttcaacacgttattcattaccacttaccaagatctactgatatttatattcatagatcaggcagaactgcaagagcaggttctgaaggtgtctctgccatgatatgctcacctcaagaatctatgggcccattaagaaagttaagaaaaactctcgctacaaaaaatagtgtttcgacggatttgaactctagatcaactaacagaaaacccatcaagtggcaaaacactgtgcctttgttaccaattgaaaccgatatactttcacaactcagagaaagaagtagattagcaggcgaactggctgatcatgaaattgcttctaattccctaagaaaagatgacaattggttaaaaaaggctgctgatgaattaggtattgacgttgattccgacgaagacgatatatcaaagagtaattcggacactttcttactaaaaaataaaaataaaaaaatgcagaagactataaataaggacaaggtaaaagccatgagagctacgttgaacgaattgttatcagtgcctatacgtaaagatagaagacagaaatatttgacaggtgggctagtgaatttagctgataacttggtcaaaaaaagaggtcataattctatcattggtcatgaaaagacaaacgccttagaaactttgaagaaaaagaaaaagagaaataattaatctcgaggcttttgaagagaaactctcctttcactgtattttctacgtaatatacacggtcctctaaacccactatgtactttcaacaaaggaattagctcaatatagagcaaaaggtttaccaagtatatattatattgtacaaaaaattaaaagcgaatttaatttaaatctggcatctagtgattaaattctttttgattcgatttttttctcccccttttatttatttaaatgaaatcatagtcggatccttcatcttcgtcataatattcatcctcagattcatcaactagttgttcaaaattaactttgtaacgcagcatggcaccaataccaccaaaacctgtgacaaattgggcaccttctgaagatttgtctgtgatgaattccaaggtagcaccgaagtttttgtagttagctgctagccattcaattaaaggttcttcggagacaacgtccatttcttggccggtagctttgtcaatagcaaacgacttgtccttggcttctggttcagcgaattttataacctcattatcctcggcatctttaaatgtatatctgatagtttccaaattttcgaaaacaattaatttttcgactgcacctaaatccaatgcctttaaagtatcatctataccataacagaatttaccagtgtcctgggaaatttcgtcaaaatatgcctccaataatttcttttcttgaacatacttgacattggccaacgcttcggcagaaagttcgatagcctggttgaaaccgttttcaccaccataagaaacatccacgatggaaataaccttacatgctagtcttggatcgaataattcagatttagccaaatcggtcttaaagtcagcagaaccagctaaaattaaacccttaacattgactttgtcattagtaataaaattttgaacagcaacttcggcgacctttctcacataattatgtcttttttcttctcttaaacgagcaaaacgaagcgcagattgaccacctctaccatgcttttttggcagatcgacagtaaatttatgtaaaacagttctcgtattaccggacacagaaccaaacaaagtaccttgaccgtccatgactataaaaccgaacttgtcgtcagcttgaagcaattccgaaagaacttctgtatgaaatttgttatcacacaaatataaggatgtgttgataggtttgtaaggttcgatgtcaaaagtgacctttttttctttaccatcttcagtgatgatatcaccacaatataaaactaaaccgttcttgggcaaagtattatatagcttcaacttttgttgggtggaagtgatagcagataaaacggaaagacgattaaccctagatttaatattcgaggcagtaccatattcatctgttaacattttttggtacagtggaatttgacccttaggaggaataactaaggaaatcatagaagtaccattacctctagctttttctaaagattggaccaacttcttgaccttccagatctcaatatttttttcaacctcgttatccattattgaagtatttcctttgtctatttctgtagtcttaataaggagacaagccgaaatgaattaagaaataaaggtgtcgttaaggccacaccaacagtatatcagttaaaaatacagtgatgtatttcattgatttgacgcttagcactggatttctgaaaaaatttttcattcagggtcaacggaataatccgggtaataaagacggcgctatcaaacggtattactgaaaaatgtacaaatgatgagagagcaagtgacttaagtattcttcgtacatgcggtagcgacagattgtagtttatgatctggttataataccatgtataaattggaaggatctaagctaaagtaaattatgaattgaatactgcccttcaaaaattagattttgacaggatgctttttaacaagtctgttatcctcttcatggaatcacaaatttaaccagatatttgcagcagctattgggggaaatgatgtagctaaggtctacctcatactgctcatatccagctttttacttacttttcgtttcaaggctcccatactatctataatgagtagaaatatcagatgactatgtcattttgaagttggttagaatttgctttttggtttcgacagcatgtgcacattcatcattgaccttcgctaaaggtagcgccaccaaaaaggagcaatgaattgaaataaagttctcagtcctctacttgtccagttcttggcacattgtagagtcttacgtcaaatgttctgttggctcacatacgtgctcttcgtattttccatgaataacttcagctatttatgtaaatgacgctcatactctttataaatctgaaaataaatagcacgcatatacaaagtggatcaagaggcgttatatccaaacatttcagacagaagattatataatgtaacagaaaaagttttaaaaattttggaataaaggaaaaggtggttggggaagagaatagagctacagcaagtaaaaaggtgctttcctcgaagttgcgtcgaagatgaatgaaagtagttgctaattcttactagcacatgaaaaaaaaggatatatataattttacaagtagtgtcttcatgacggattcatagtctatccaagcgtttgcccaaaattttgcagtaaatttaatgttttctgtataggataatggtgcgccattcaagtcccgcgaaaaatgactgatgtctacaggacaggggcgcaatatatgttctctgacattgcaccttttgaatatatcatgtgtttgttctgctatctgcttgtagaagggtacgctaacagagccggcggcattgtaaaaagttctcctttcgcggaaggatgagtcaaaaagcatgtgacaatgaaataatcaaattgtgacatctgctgacgcgggatcgttccttcgtattgtctagattgtaatctatataacatactacgaatataaaagagggactacaagatatttctagcgcaaactactgctttactgtctcacaatgtctctgattggaagatacctaagaaaattatttaactacatatctacaaaatcaaagcatcatgccttcgcaagtcattcctgaaaaacaaaaggctattgtcttttatgagacagatggaaaattggaatataaagacgtcacagttccggaacctaagcctaacgaaattttagtccacgttaaatattctggtgtttgtcatagtgacttgcacgcgtggcacggtgattggccatttcaattgaaatttccattaatcggtggtcacgaaggtgctggtgttgttgttaagttgggatctaacgttaagggctggaaagtcggtgattttgcaggtataaaatggttgaatgggacttgcatgtcctgtgaatattgtgaagtaggtaatgaatctcaatgtccttatttggatggtactggcttcacacatgatggtacttttcaagaatacgcaactgccgatgccgttcaagctgcccatattccaccaaacgtcaatcttgctgaagttgccccaatcttgtgtgcaggtatcactgtttataaggcgttgaaaagagccaatgtgataccaggccaatgggtcactatatccggtgcatgcggtggcttgggttctctggcaatccaatacgcccttgctatgggttacagggtcattggtatcgatggtggtaatgccaagcgaaagttatttgaacaattaggcggagaaatattcatcgatttcacggaagaaaaagacattgttggtgctataataaaggccactaatggcggttctcatggagttattaatgtgtctgtttctgaagcagctatcgaggcttctacgaggtattgtaggcccaatggtactgtcgtcctggttggtatgccagctcatgcttactgcaattccgatgttttcaatcaagttgtaaaatcaatctccatcgttggatcttgtgttggaaatagagctgatacaagggaggctttagatttcttcgccagaggtttgatcaaatctccgatccacttagctggcctatcggatgttcctgaaatttttgcaaagatggagaagggtgaaattgttggtagatatgttgttgagacttctaaatgatcttttgtaacgaatttgatgaatatatttttactttttatataagctattttgtagatattgactttttacgatttatttgtaacaatgagaattactccatttctgaacttcagtaaatagcgagtgattctgtactttgcgagaaccggtggacatttggtattttgccttacaagaacaacctatacaaacgtttcaatatctaattctttgtaatccattgttttacgagacatataatgtgatatatagatgaactttacgtataaaatgatatatttaaaactagcaactgcgtgcgtaagacaaactgaaataggccatttacggaaaagaaatttaataatgtcgactggaaactgaaaccaggaggagtagaaattggttaaattgattagctaaaatttactcgttgtggacagagtttgagccaagcggaatgttttcaaggctttctttgtttcgaagggcagctctggctcctgcccctatgagaatgtcttttaggactatttatcaaaaaaccgaggatgaattgcccagaaggatcgtcccaaagctagccacattttattcggcgaatcctaaccatgaagatcgtattaatcgactcgaaagacttctaaggaaatacataaaactgccatctcagaacaacaatgaagcacaacaaacaaaagctccttggatttctttcgatgagtacgctttaatcggcggtggtacgaaattaaagcctacgcaatatactcagctactgtatatgttgaataaacttcacaacattgatcctcaacttactaatgatgaaatcacatccgaactatcccaatattataaaaaaagttcaatgctttccaataatatcaaaatcaaaactttagatgagtttggaagaagtatagccgttggaaaaaggaaaagttccactgcgaaagtattcgttgttagaggtacaggtgagatattagttaatggtcgacaattgaatgattacttccttaagatgaaagacagagaatcaatcatgtatccacttcaagtgatcgaatcagttggaaagtacaatatttttgcgacaacgtctggaggcggacctacgggtcaggctgaatcaatcatgcacgccattgcgaaagctttggttgtgttcaatccattattaaaatccagactacataaagctggcgtcttaacaagagattacaggcacgtcgaaagaaagaagccaggaaaaaagaaggcaagaaagatgccaacatgggtcaagagatagtcttagtgcatcttgttacctcaatttcgaacggaagcgtgcgtgctctgagttttttgacacatgccagaagaaacgttatatattttgcatacaacgccgcccagcattagaagcacaactctcgttcgttattcctgtaaataaagttatatgtattcgaatattgctcagttagtattttcttctacttactgcacataatacttcatcttttttttcctctcacccgcaaagcaaaggggccttgcagcaatgactcaaattccattggaaaaaagaaggagatgataagatgcaaatcagaatagattttactatgaccgttacatgtaaaaagagtcataatataaaccataaatactacaaataacaccgggttcaggcatataaataaactattctcctgtaatatcccacaatattttgttataacccagacgtaatagcctcaagcgagcatccctaaatttctgccatgaagctgatcccaattattttgaatgctaagaatctcagtgggatggctggatccatatcaatatgctgttggattgttgtgtttgtaccacagatttatgaaaacttccgaagacagtctgcggagggattatcactgcttttcattgtgttgtggctattaggtgatatatttaacgtcatgggagctatgatgcaaaatttactcccaaccatgataattttagctgcttactatacattggcagatttaattttgttaatacagtgcatgtggtatgacaaggagaagaagagcattttacaagaagtcaagaaaaatgttgatcctgtgcatttgcctccagcaaaccccataaatgagactgtcttacaagacgtttttaatgaatatgagccacttttgccaaggatagaagaagaagatagccaatcgtatagctcgcttgagcttggcagaacaatagtcgtaaaggaaagagagaattttttcaatgacttcttaattgtttcaggtgtacttattgccggaattttgtcatggtatatatcttactgttccggcctagataacggtattcctaaaaaaaaacctgcgttcgaacagattaatttacctgcacaaattttagggtatttaagtgcgatactgtacttgggctctaggatccctcagattgttcttaacttcaaaagaaaatcatgcgaaggagtctcattcctattctttttatttgcatgcttagggaacacttctttcataatctcagtgctctcagcatcttggcttatcggtagcgctggtacgctgttgatggacttcacagtttttattcaatttttcctttacgccaaacctaaatacgagaaaatactaatagataattaactagttggcttctattaatctttccacttaaaactcaaacttactcatatgcgcatcggctatagcccagaactagtattttcattttatggaggaaacaaaattactagcgccatcacggctcagtcgttattttggcgatgccctttgctgacacgcgtctgaaaaaatacacaaaaaataacacaaaaacgagtaatgccatttcctgggtggggtctctatccatagaggaaaaaaagtgacaggaaggggacaaattcaactattcactgtagtcatctaataatttttttaacttaatcacaccaacaaaaacaaaaaaaagctaaaactaggttgaaggattttaagagaagttattgcaccggtgtattaacatatataaggatacgtacgaacataacatcatgtccagcttagccgatacagtagagggtagcgaggccaaacgcggcagattttccaacaatgcattaacctccgatactggtattttacagaaaaatagtacattaagaaactggtttttaaaaccgacagcagacctaaaaaatagttgcgaagatagagttgaagatgacgtcaatgatgtctacttaaatgacaaaaactcacaaaaatctgttgaagaaagaaaactaggaagaaaagttagatcttttttcaaacaaacaaactcaaataaggacgagtctgtgttggaagatgaagatgatgcgttagtttggaagaaaactagcaataagtgtgcaaaaaaggaaaattcccatgacatccaaaaaggaagtttcacaaaaaaaatcagaaacagtattttcaagagtgcaaatgacgtgaaagaattcaggaatgaaaataacttactattgcccgttgaactttcttctgatgatgagaatgagtctcatttcactgatgctaactcacatgttatgcaatcaaaaagtcccgagaaaataccttccaaggatcaatgcttgactaaaggcgctaagaataaaggtctgaaaaaggaatatgaaaaaagttttgaagagtatagcgacgacagtgacgatgaattttctcctgctactccaccggagaatgttcttgaaggtccttacaaatttgtgtttcagacaccaaacacatttacatctcagcctaatataacagtagaaaatgattttcacaaaggtgggagacatgtgattgactatctgaacaaaaaattggctactatgaacattgatattgatttgacttcaggggggaaacaaaacgtatcttgggaggaagagctcgaccaattgagcgaccacgttatagaaagtattactaaccacatttcaaagggtagaatgcacgcacaagagaagcaagatgagttggaaaagttaaaattggagaatttgaacttgtcaacattaaagcaagaaaatctccaacataagcaggaaattaactcattgaaagacaaccttgaatccattagtaaaaaaaacaatgatcttatattggaaatgaacaaattgaaaaaaaaaagtacgaataataaaacaaatgagtacatatctacggatgaaaacgaaaatgaggagattaccaaatccaatatgggtcctggcattttagaactgaacgtcaacgaaacttcaaaaaaattacagcaatccacattcaaaccctcgaaatatcttccaagagaaacgagaaacaatgaaaatagattaaaacacttggaaaagagaatatttggcttagaaaaatctcttgaaaaaaaaaaaaaacaggtaagggctgacagcgttagattagacttgaatagatatactatcgaccagtttttgacattactgaaaagcctcagcgaggttttgcaattccacaatgtttatggcaatgatttgaaggaaaacgacgataatattataaagattgaaacctgctgtagtgcgctaaacatgaaaaattgtttcgaagactcctcatttcgtttacaagaaaacagcttcaagaggcaattgggccctctgttcgcaaacatcaacttctccttaatcgaccaactgacaatgaacttcaggttctacgagagatctgccaatttccagaaggaaacaataggtgggttaagaatgatgctacaagataaggataactatatcaaaacactgatgcaacatttgaagaaaaaagagagtacaaagttgataaaagacagcaagaatggcgcctccaccttaacatcttaacaatttcgtttactgaaaatgctactagtatataatcattaagtatctaactatcactcaataaaaatattatagatcgcttaaaaactcgtttattgccgattataaatccaccaaaagccgctctacccttacctccgcctggaaaaattataatatataaagtgagcctcgtaatacaggggtaaaaaggaaagagggggatatcaagcatctggacttatttgcactatctccgccttcaattgataaaagcgtcttgattttaatcaactgctatcatgtcttcttcagtagcctcaaccgaaaacatagtcgaaaatatgttgcatccaaagactacagaaatatacttttcactcaacaatggtgttcgtatcccagcactgggtttggggacagcaaatcctcacgaaaagttagctgaaacaaaacaagccgtaaaagctgcaatcaaagctggatacaggcacattgatactgcttgggcctacgagacagagccattcgtaggtgaagccatcaaggagttattagaagatggatctatcaaaagggaggatcttttcataaccacaaaagtgtggccggttctatgggacgaagtggacagatcattgaatgaatctttgaaagctttaggcttggaatacgtcgacttgctcttgcaacattggccgctatgttttgaaaagattaaggaccctaaggggatcagcggactggtgaagactccggttgatgattctggaaaaacaatgtatgctgccgacggtgactatttagaaacttacaagcaattggaaaaaatttaccttgatcctaacgatcatcgtgtgagagccattggtgtctcaaatttttccattgagtatttggaacgtctcattaaggaatgcagagttaagccaacggtgaaccaagtggaaactcaccctcacttaccacaaatggaactaagaaagttctgctttatgcacgacattctgttaacagcatactcaccattaggttcccatggcgcaccaaacttgaaaatcccactagtgaaaaagcttgccgaaaagtacaatgtcacaggaaatgacttgctaatttcttaccatattagacaaggcactatcgtaattccgagatccttgaatccagttaggatttcctcgagtattgaattcgcatctttgacaaaggatgaattacaagagttgaacgacttcggtgaaaaatacccagtgagattcatcgatgagccatttgcagccatccttccagagtttactggtaacggaccaaacttggacaatttaaagtattaagacaacgactttattttcactttatttagttcgcttcttaatcttgtcaaaaacaagatattgtgtaatcgcctcaagtaaacaatatgtttttcatacgtgatttgaagtttttaagtatctgaaatacatacgcgcgcgtatgcatatgtattagttaaattactcgaatgtcctttatataatattacatttttacacacacattcttgaagaagaaatcccgatcgtaaaaaaaaacaccgtgctccaaatggccttcaatcttttcgaataatttattcgattgttcattctcatctctataatcattcgccgtacgttcaggatatgacgcatcaagcagcgaagctaaacctgttggaaataaagatctgtcatagtcatcgtcttcttcatcatcatcagcaccattattactataatcatcatcattgtcatcatcatcatcatcatcatcatcatcatcatcatcatcatcatcatcatcatcatcatcattaatattgttgtcattgtcattattgttactgttactgtagttattgttattattattaatagtactactactattattgccatttttattattattattattattattattattatcgtcagtatcatcagcgccagtagtctcgttattatcagtattggtaccattactatgatgatattcctcgcctggctcaagagttttattttcccacaatttcggaatgcttgaaaattgcaagaagttcaaatcctggattgttatttcattgaaaatattgaaggacacttccattttttcttggtcctctgtaacgaaactaccaaatgcagccatcttctctttatttatgaacgaagttttcaagagctcgaccatatcatcttttgattctctcgtatgcttaactaacctattgagaacaccctcataataatttgaatcaaaggcatagaattttgcgtatttacttgtcagattgaacttttccatcgtactccgtagaaaaaaagtgtaaaaaaaaagagatgtttgccacttcagattgtgtactgaaagacagcgttcttcagatccaagcatacgggtatgtgtatccctcaataatccaattatataaccagtctccatggcatgttcgtcattaaccataatctctgacaaatacagaaacatggaaaaaaccgttgtgagagaaaaatacagaaactcattctgaacagtagggtagtattcaaaatctttcaaaatattaagtacttcgatgcaatttcgcttgaaatccaatcttgaccttctaataatttcagctatatcatgccgggaactttcccgttgatctaagttatctccaatgatggatatgacaaataaactcagggttatcttttgatggtaccatctgaggtgtaatagaatagtagtacaacaactcacttcaaaatctaacttcgaagaatccaaagataaaatcctcatgttttccttgtaattttctaatgataatatggtgggcaaatcgtctcgcattctatctaacgccttttgattttccagtacattttcaatgatttcatctagtgtatcgtctaaagttgttctgatggaaaaacatgagtaatatatttgagactctatgagggataatctcgacaaaaaatatgattgaatgtatggtacatattcaaggtgattcgcgagtaagtttacaacggatacaatatctttcaccccttctagttttgaatcatcgtattttatagaaagattgggcagaattttatctctgaatagttcaacatagctttcatctgttaatacatcagtgttttcctccttgagaaagggcggtcttgacaacaccacagaaaagaatttgtctgttgaaaaacaataacaccacaagcgtcttcttttaatgatttcatcaagttctagatcctcataggtggaatgtaaattgagccgtaaatccaaagccactttgatagcaacggatagtactttgaccgctgatgaagcacttattttttgttgggcaaactttgccagtaacagtaatgcctttaatgccgtcatatctgcgcgtgctacagacagtttatggtagtaatagacagaattgagaaaagtgaaagatctgagtctccataattcgaacttctcaaaataataggtttcatgattatcttcatcaactagctcctgcttctcctcaaaatttgtaacggtggccccaaggcagaggcagatatttagcaaaaatgcctgtgatgatgtcaatcttcctttagcaggatcaaagtgcacgtcggcaaattgcaaacattgatctacatccactatgtggagaagagaggctaatgatggacattttatatttttgagcaaacgctttgcaattgctaaacggggcagaggatacaaaatattatcactagatggtgatgatgcggatcggaaagagaagtccaggaccagcttggtctgtaaaatagaatatttgaaagtagtagtaaacatttcattaatgggcgaaagaaattcttcgtcagttaaatgtgataaaacattttgtcgaaaatgaaacattttttgttttgttaacaaggcctttgaatattgctttcttttaggccttttcatgtattctttatcaatgacgtcaattttgcttttttcagctagcttctctattgttcccttcatgtttttacaaatctcttccaaaacaaaaactttcccagcaaccttcgtatggttgagttcaattttttcaagcactgtcctgtcaataggaacaaagtcaggccaagtatcttctttatcgcttgcacttttgccggcagaaactccaatatattcttgtgataagttggtgtgtaatttcggcgagctgtctgtagaagaagtatttcttgatcgcacggcgatatcaaaattttcatccttgaacttattctccttatccaacctcggcttcttaaccgacttcccatttcccttgttattcaaagcttcttctcgccttcttttcagttcttcatggaaatgaaacgtgcaatctttattatacttgatacagtttctacatttaccagaaatcggctcgatttccgtacatctaatcttcctcttccgacaataatcacatgctttagtcactctacttttgaaagactccatgttatatgccagaaaattcttatcagcaggcatcatatgagctaatgggtgatgtcttaaacggtgatccggaaaagggctcaactgaggcgacattattgtaccagttggaacaggcggaaaatttgatggtactggaggcatcgcagggacagcggggcccattaaaactcttgtattttcgactctttgattatgtttctggttagctgcccactcagaactttgcttttgtgtcttatccatgcttccatgactacttgtaataccagaatccatattcattcacacaactcctgctgggcttgtaatcattgttaacttaaaaaagagtagtcgtaatataaagtttactctattttaagtagactttgggcagtggctgaaaataggcatgataaatcaacattttctggcggagtagggtcaaaatgaaaatgtggaccctttagggtattataaatattttttaaagggcaatttgaactttttaggtgcaaagaaaattctgaaggtataaaaaagagggttcaccggtgctgcggaaataaaagcggaaataaagatggaaataagggctaaaagtttcttaaaacaagtgcaaggagagggagagttccactcttggcgctgatgatatcttctatttatattgttgagatcatatgatgataacgcaaagttgaaattctaaccgaatagtagtataacatactggttttctttctgttcgaggtataagaaaagaaagtacttggctatattcggaggaggcaagaaggcggccaagagagagatatcttctttgtcctttgaattatggcttttttgaatattttcaagcaaaaacgtggtgatgaagcttcacaactgagcgcaaagggacgggaggaaatttctcaatcgattaagatatgcaaaagtgacgatgctgctaacgaacatagctgctctggtgattgcaaaacagaaattgaagaaggagagcaggcctttgcgaaactaaagatcgaacatgaaactcctttgttgaactcttctaaaacgccaaaaattcacttcgttgtccccacctctcaaatcgattggcagcatgatgcctgcctcgaggacccaaagtcagtacagtataaaatttcccagtggtgtgataagaattcagctaaattttccaacgtgggcacaggcaagacactaaactgtgcagtttcatctttacctaaagatatcatggatattgatgttatgcggggaaccaagaataatgtacttattttgccttacttcatttggctgaacgaccttagatcagatgacgtcgaagcaacgctggatggtttagttcctgacttattagacgagaatatttcaagagagaaattgctagaaacacgaccaaatgttgccgttgcacgtgaacgtgcatttgtatttatatgttcacatactacgagggataaacgatgcgggattacggcaccctatttaaagaaagtttttgacagtaaattacaggaacatgggctgtatagggacaattcggattacagggcagagggtgtcaaaattgcatttgttaatcatgttggtggtcacaaatttgctgcaaatgttcaaatttatttacgaaatccaaataccttaatttggttgggaagagtaactccaaccatagttccttctattgtcgaacatctgattgttcctgaagaaccaacgttgccgtttcccgaaaaagttcgctgtattaagaaatatcaaagctggtaaaggttggccagcaaaatacaatcttttgacgccataaaatttgccatcagagtagcttttaaatgtacatagttctaaagcacgcatatatatttataacgctaagatgataatgaaaagttttatttgcaaaagggatcctgtatttcaactttccatacatgaaagattctttggccattttcttaatccatttcatattttcatctgattttttttctgttttccacttgctgctcattatttcattttataatttttgcaaacatgcaatatttcgccatatattgagaaaagcaattcttcgttgttcccagtaaagaaagaacaaatgcagatttctaccgccaccgctagattaagaattttttttggttactgatttgaatcacatacgatgagttttagacatttcaagaggagacttgacacaagctcagcagatgaaagctcttcggcggatgaagagcatccagaccaaaacgtatctctaacagaaaaatcagcctcattaagccatagtgatttgggcggcgaaattttaaatggtacaggaaagaaccgcacccccaatgatggccaagaatcaaatgaaagtgatgggagtcccgaaagtgatgagagtcccgaaagtgaagaaagtagcgacaacagtgattcgagcgatagtgacgatatgagacctttaccgaggccattatttatgaagaaaaaggccaataatttgcagaaagctaccaagatagatcaaccctggaatgcccaagatgacgcacgagttctgcaaacaaagaaggaaaatatgataaaaaacatcgacaaagctaatcaagtggcaaagaactacgaaacgatgaagctgagacttaacaccaattacagcaccaacgaagaattgatcaagcagtgcttgctcttagatgataacgatgaagtcgattcagaaaaggagagacagaaatggtttgaaaggcagaacgaacgaaagcaaaagcatagaagaatacaacttgcgaaacaaagagaatcagaagaatatgaggcaaaacgatttgaagcgatgcaaaaaggcaaagatgggaataccaaatacgacgttatcttggacaaggagaaagagaaacttgatcacaaaaaacaaagatcggctgaaaaagtagaaaaatctcacaataacaaccgttacaagattacaagaactaaaaatgttgaatttggtgacctaggcaagaatagtagagattacgaagaaactgaatattcggttatataacaccgcatcacacacacaaacccacatgcctttcagttagttgatgtcgggaaaatcccgaaacagaaaaaagaggcaaagatgaagatatcaaattttttcgcagaaccattacatctggctttggatacgatgaaacaatctagcagaaatacagtaccaacctattggtagcttctttgtattactatcaacaattttagaagatatgtctttgacaccactgtgtgaagatttaccacaatttctgcaaaactatctaccgaatgctggtcaaacggaaaataccattgtgccctttgtcacactaacttatgctcaatcgctcgacgcgagagtatctaggggccctggagtgaggactacaatttcacatcccgagaccaaaacaatgacgcattatttgagacatcatcacgatggaatactcgtaggaagtggaacagtgctagctgataatcctggattgaattgtaaatggggtcccgatccggctgcaaattccccaaggccaataataatagatacaaagcaaaagtggcgatttgatggttcaaaaatgcaagaactttttattaaacgacagggtaagccgccaatcgttgttgtcacaagtgagcccattataaaagaacaacatgtagactacgcaatttgtccaataaatgatactacgaaattggtcgattggaagaaattgtttgagatattaaaagaagaattcaatataaggtcagtaatggttgaaggaggtgccaatgtaataaatcagttgttgctgaggagcgatattgtcaacagtcttataataactattggatcaacatttctgggtagctcaggcaccgaagttagcccaccccaaacagtaaatttaaaggatatgtcatggtggaagggcattaccgatgtggtgctttgtgcgagactggccgatgactaatagtgttagaactccaccttctgtgtaatttctttctgaaattagtgaaaaaaacgcgcctttcaaattttcatactagtgattggtttattgcagattatttatttctaattgtacatattcttgttattttatattatatgaaaggggtaaatccaaatgccactctacatacagattctgtaactggcataacgaccagaggtttcactttttcttatgattttaactacttcgcctcttttcaatcccaagtataaggctacaggatcagctctttgaattcttggcaattgggattccttcaatctatacctttttaaaagctctcttttctcatcactactcaatctgatatgctttggaaccaattcgtggtgagtaatattaaccactaaggcagcttcattaaaagtttcaatggtggctggtggtatagaaggcaccaatttcattgcacttggtgtaatattattttggtaaacaaagatacctgtttggaaatttttttcttgaatatgtataacaaaagtcttcattgtctttacaccaacggaaggctcatcacaaaattctacccataaggagcccatgtctgggaactttgatatagattcttctgttggatttgcctggaaggacatcattttacgttgtggtctgcccatggagtcacaatacttggccttgaaatcttccaatggcaattcgacttcctcttgagtgataaaataacccctgtccttaaccatttcttttactgttctgaatgctctccataatcttgagatgtttctttcattttcttggtccattgtcttagcttattagtaatatccacctgcgcacaaattttgtaaatcccctactaatttaatttgaattcaaattggctcgtgatctgttgacccttgttagcaacgtttgtaatcttcctcaccgaattgcgtcgttttgaataatatatatgattgaaaatttttcaagagaaaagaaaaatttttccttccgcggtcagccattgctaaaaaaaggcctccgttaggagtcgaatagaggacaacaacaatacattgccactttaattttaaatgcttgcatattaactagcgatcagatgctctgctctatataaaataaattattgatacggtttctagtctcggttgatgataagagtacgttaatccacctaccgagcattaccaagatatctggcactttatatgtagagagtctgtgttctcaagtttacttgtgcggataatgagcttaaagacttaaatactaaaagcgtatgcgttcgtatctctgtttaggcaccttgtacagtttcacagaaaactgtgtaatgtgtgattatagtacacagaacaaaataacttcacctcatctctttcttaacgcagtgaggaaaaaggtggaaaaaaaagaaagaaaaaaagaatatgtgtaatttccggcacttttcagagcgatgagcttaaattcaaaagcagcattgaattaaaagtgaggtcttgagcactacattctagcaagtaaaagaaaagaataaattggttttgcatctagaatgagctccgttaacgcaaatggaggatataccaaaccacaaaaatatgtgccagggccaggtgatcctgaacttccaccccaactatccgaatttaaagataaaacatcggatgaaatcttgaaagaaatgaacagaatgccttttttcatgaccaagttggatgaaacagacggtgcaggtggtgaaaacgtggagttagaagctttaaaggcattagcttatgaaggcgaaccacacgaaatcgctgaaaatttcaagaagcaaggtaacgaactatacaaagcaaaaagattcaaggatgcaagggaactttactcaaagggcttggctgtagaatgcgaagataaatcaataaatgagtcactatatgccaatagagcggcatgtgagttagagctgaaaaattacaggaggtgtatcgaggactgcagtaaagctctaactattaaccccaagaatgttaagtgctactatcgtacaagcaaggcttttttccaattaaacaagttggaggaggccaaatcagccgcaacatttgccaatcaaaggattgacccagagaacaaatcaattttgaatatgttatcagtgattgatagaaaagaacaagaattgaaagcaaaagaagaaaaacagcaaagagaagctcaggaacgtgaaaacaagaaaattatgttagagagcgcaatgacgctgagaaacataactaacatcaaaactcactctccagtagagttacttaatgagggtaaaataaggctagaagacccaatggattttgaatctcaattgatctatcccgcattaattatgtaccccacgcaagatgaatttgattttgtaggtgaagtaagtgagttaactactgtgcaagaacttgttgacctagttttggaagggccgcaagaacgcttcaaaaaagaaggtaaggaaaacttcacaccaaagaaagtgttggtgttcatggaaacaaaggcaggtggtttgattaaagctggtaagaaactgacatttcacgatatcttgaagaaagagtcgccagatgtaccattgttcgataacgctttgaaaatatatattgtgccaaaggtagaaagtgaagggtggatttccaagtgggataagcaaaaagccttagaaagaagatctgtgtgaagtgtcaaatagttaaaaatatgtaacgcaaagttgtagatagaaataacaaagcaagaaggaaaagtaaagaaagtgaacgatatacgtaatgcagggggaataccagagtatttaaagtgtacttgatttaatgttaaccagtttgaatttttcttttctggggtaatcgaattcaagaccttttgggcacaatttgacgcggtttcaacctgtttagcctaggatttgggaaaatttcatcggtgtgcaaaggcggaattggtccaaagatagtttgtggatttatatcttgctgtcttatcaattgctcttgcaaatacggggatttagcccatgccgctaaagttacgctagcctcatcttcagaatcagtatttatctctggtaaagaatcattgacagaggctatctttggggtcacatttccgattatttctcgatggtcaactgtatttattgtggccaatatattgtcggtactaaatgcagtatttttgttgatggtatctcgcacatgattatcgaaaggagccaaagattcttttagacgtatgtccttgtagtcattactaaagcttgtttgcttttttagatcttgttccaaatgcgacatccttttttgtttctcttgtttacgccgatgatgttcctgttgagacctcataattcctgataaccttttatcaaactttttttttaagtcatctcgttctgcctctgctggtggaagtaattgaaggtttgtaagccgataatttttggatttacgagactctggcttggagatgtcagcaatattcggagaaagttttcttaatgttttctctttaattttcaaacgatgtggcgtttgcgacgttgttaaatttttatttttattaggcgaaatagacgcttttgttggtctcaaataacctcttacagggctttggtaataatttttaacttctttagatggcgagcttgaatcgacacttatttttgttggagaaatactgtgcggtcttgaaccagttttatgaacatcactagagtgtttggacttctttttctgttctgcaatgattgctagctttttgtgtgtcgttagcttcaaagaagtcttatcaaacctcggaatagaggattttcgagagttttttcctttgggtgaattatttttggttattttattttttactgagaatatatctcttaacgcttcttgcatatcagtatccgtggagtttattgacttaaacttttgagaaacttttttcatgggggagcctgttaaatcgattgatgaagaggagtatttgtgaccaacgtttccacgggaaattttgttttcaaatgattttgttggaatagatgatagcctatcgaaaacactggatgcttttgtagatcccgcggtatcactgttttccacagctcttatagcaggactatttatcgtagatttttttttaaatgcgattggtgattcctttactgttcgtacttttggtattgatcctgaagattttgttggtggaatgtgttgaataataagaggatctttattcggcagtggaacaaacatattcgaccttctttgagatctcgctatcccagaattcggtggtggtttcacctttactgattcagctttctttaaagcttgaagtataggttcattctccatttcttccttagccgcccatgtttgattatcgaagcgttttgtattaatcggagactccgaagtcttggaggattctcttagaaccttttcaactttgtaaggtgaccatggtgaggatttttcgctttcattggcgtcgactttaacgctattcaatggctcaaccgggcttttattggtatcatgtatactaaatctattcattccttcggtgacttccttcctgcggagtgatttaggcgtgatacttttatcgttatgtaatccatttctgggtgtcttagtaacgtcttttgcggcatcattctgggagttagaaagttcatattctcctttcattttaggaaattcgacatccattttgttatgcgtattttcggggctaattaaagactcttccatctttttgtcttcatacttgagtgtattcatataaacattatttcttaaccattcactactttcgtacaatcgttgatttatttctgaatgtgcatctgttgttagattatttagatcatcgagggtttctatgattgaacgggtagagcctggcttcctttgagttttcttcctagctgctttgattgcccagtccattgtttaaatcttcgggctctttcaaagtccgtcagttgaggagatactttgaaacgttttgtttgtatcattggcaatacttgaaacgagtttttgtttgttttctttttttagttaattcgcgaaatttaaaatatgaagatcggtttcagaacagaatggatcaggcttttccgcgtataagaaataataacactgacataacgctataacgaaacagcgtaacaaaatactctttacatggtttatttttatatattcatttaacattatcaaaactaacattaagtcctttatttatcaaaacaaacgaaaaaaaaaaatgcgagacaaatgatccagtcatttattgtcaatatctaagtcaattagtggttgcaatatgtctccagtttccactttatgagcaaaaattttgccctcaatatttatctgatttttttcagcgaattctttcaaactcccgaatctaccgcttgcgtttcttcttaattgttcattggtattcatgattgtgtttttcggggacatttggtgggtatatgaagtatccggtgaagaatgatattctttgtccaagaaagaacttgccaatgaagtttttcttgaattgacgcctatgcttgaattagaatcgtacccgtcaatgaaatttggcttacaagacctgctgaatgagattgcatgactttttctgtggtaacttttccttcgccctgaaggctttgtaagttcgtgtgataatgaacgtgaatgcgaatgtgatgataattcattactttctacccttaaaggtgataccgcattaggctttcttggacatatggaggaatttctcctcttttcacaccatccttgtctccagggaaagagtaggtcttcagcttgttgaacagagcttcgccttgagactcttcaaaataaaagctcttttcgtactcatggggttgtttgctgctatcgaactgagattctgttgaagagagagagctgaaacgtccatagagtgggctgccaagtgatttaatggatgtactagattgactgcccgtagtaggaaaactaaatgtgcttattctttctctttctttttgctcaaatttgcccatatcttgctggaaagggaaacttcagtgaagtaataacgaaggtggtgtagagtataaatttttattaagtatgcgctttgacgttcacatatttgtaaaagatttatttgagaagatagaatgggtctcatttatttatacttaaatgcttctttggatgtcaagctttcttgatgccggacttgcagtcgaagggctctttcccaacagatatgtaaccaaatgcgtcgaatagaaaaagaaagtcttccaaggaaagtttattacgaggggttttgtgcattaacgtggcatataattaggtataaactcaaggttggcttaagattagcgaaacaaaagtataaacgacccaaaattggagtggatgtgttctttaacacataaactgtcgtacaaaaaaaaaagaaacaaagagcagttgaaagaacatcaagatcataaggacccccatatcgtgataatcattgatgaccaaatcgtgaactccctgcgcctatgccgtgccatagcaaataaagtactgggctggattgttaatgacttgcatattaacgacaggtaaacggtaccctatttttcttttttacgtgctacggacgaaaagtgagggtgattaacgcttcaaataagaaacgacggctagcagggtctagatgcgtgagatgagataaggaaaagagctctgtgtcccaggtaataatccctggagagatataatcttccctacaacttgattgcatattaacgctcccaagttgtggccattgaagagctctacagcaatgtcccgacgaacggaaataaccctctttttcatgatattttcggagttatctccactgtcaacaactattctcgaatataacagaatgaaagggatcacgtacgcttgttatattgctgtcgttctccgttcgcaatcccattatatgcgaggggcaaaagaagagacggccggtaactcattttttggtgtgtgagaattgcggaagcttcgttctcccaccttttttcgctgtgtttttcttgtcctcagcaccggctggtcaagccggtgctgaacggccggagagaaatataaacggatgaaaacgtgttaataattgcatcagtagtaggtggcggggttgtctcatttttgttatggcgtaaggtgaaaaattgtaaaggattggttcggttgggttggcgacaattaattatgggataaaaaattgcttaatctttattggagcaattacctgcataggcactcataggccacaagggtttgatggcggaaggatgttatacctacgatactaccatacatgtgatatgtcactttctagtccgaagcgtggaacatattatcttgtttgacgttgtgggtgttaaccgtaattgtctgggtacgccgaaggcacggagaccatgttaaaatatgtttctcttttttgctcatttttttctattttttgctgcgcattgcccgaagcttttcttagtggtagtctgctctcgcgctctttgttacactcgcaaaatttttttgctgggcaaaataaagcactctccggccattactggctgtcgtccgccaggattttcattaacttgcagaagtaaacaaacaaaacacaattatgacaccgtggaagtttcctaaatggtaacaaaaagcttaattgaaagaaagaatttccttcaacttcggtttcctggttccgctatttctcgcttgtttcttctattggacttaggatgtctcatcaatcatcttattcctgctggtgttttttgtatcgccttgccttggagtgtttatgcttgtcctttgttcagtaaccattcttcaagtttgtttcaagtagtaggataccttcagatatacgaaagaaagggagtatagttgtggatatatatatatatagcaacccttctttataagggtcctatagactatactcttcacactttaaagtacggaattaaggcccaagggaactaacaaaaacgttcaaaaagttttaaaactatatgtgttaactgtacaaaaataacttatttatcatatcatttttttctctgtttatttcttctagaacttatacctgtcttttccttttattctttgaatttggtttaatatccctttttggtttaatatccatccattcctttcacttagaactaataattcccttcgtttgataatttatcattttccttttctgttagtaaagtacccattaaatgaaactagaacgcgtaagcagcaatggctccttcaaaagaggtagagatatccagtcacttgaatctccgtgtactagaccgctgaaaaaaatgtcacctagtccatctttcacatctcttaaaatggagaagcctttcaaagatattgtaaggaagtatggaggtcatcttcatcaaagtagttacaatcccggctcaagcaaagtggagttagtaagaccagatttgtctttaaaaacagatcaaagttttcttcaaagtagtgtgcaaactacgcctaataagaaaagctgcaatgagtatctttcaactccagaggccacaccattaaaaaatacggctacagaaaatgcatgggcaacctctcgagttgtttctgcatccagtctttctatagtgacaccaacggaaattaaaaacattcttgttgatgaattctctgaattgaagttagggcaacctttgactgctcaacatcagcgaagtcatgcggtctttgaaattcctgagattgtggaaaatatcataaaaatgatagtttctctagaatctgcaaatataccaaaggaaagaccatgcttaagaagaaatccacaatcttatgagcactctctgcttatgtacaaagacgaagagagagcaaaaaaagcatggtcagcagcccagcagctacgagacccaccattagtcggacacaaggagaagaagcaaggggccttatttagttgtatgatggttaacaggttatggcttaacgtaacaaggccttttcttttcaaaagcttgcactttaagagcgtccataattttaaggagtttttacgaacttcccaggagacgacacaagtaatgagaccgtctcattttatattgcacaaattacatcaagtaacacaaccagatatagaaaggctttccagaatggagtgtcaaaatttgaaatggttagaattttacgtttgccctagaataactcccccattaagctggtttgataacctccataaacttgaaaagcttattattccaggcaataaaaacatagatgataactttttactcagactatcacagagcataccaaatttaaagcacttagttttaagagcatgtgataatgtcagtgattcaggtgttgtttgcattgctttgaattgcccgaaattaaaaacatttaacattggcagacataggcgtggaaatttaattacgagtgtctcactggtcgcgctaggcaaatacacacaggtggaaactgtggggtttgccggttgtgatgttgatgatgccggtatttgggaatttgctcgattaaatggcaaaaatgttgaaagattgtctttaaattcctgtcgtcttttgactgattactctctacccattctttttgctttaaactcatttccaaatctggctgttttagagatcagaaatttagataaaataactgatgtgaggcatttcgtgaagtacaacttgtggaaaaaatcattggatgcccccattctaatcgaagcatgtgaacgtattacgaaactaatcgatcaagaagaaaatagagttaagaggattaactccttggttgccttaaaagatatgacagcttgggttaatgcagacgacgaaatagagaataatgtggactagatggtttttgtgactttacctataaatagtacacaacagaccaccagtaattctacacacttcttaactgataatattattataattgtaactttttagcagcactaaatttaatgaatacatagatttttaactagcattttactattctgtactttttacttgaaattccagaagggccgaagaaaccagaattccttcacagaaaactattgaactacagaattctccaaaagatacactcatagtgttaagacgaatcaatgtctcggatttggaagtcctttatagagataattgtaggggccttttgtaatgtttcggatgttctgttttaagtccgcgggaggcctttttatttttcgcttttttagagatttcacgaataaaagcgttgcagaaatgcaacttcaaaagagactgaaggaaacacagatagaagaacagtcttcaaagcaatcaattcgtgtcggtgcagcttaagaaatgacttttatgcaacagcttcaagaggctggggaaagatttaggtgtatcaatggtcttttatgggttgtttttgggcttggtgtcttaaaatgtacaacgttatcacttagatttttagctcttatttttgatctttttttactaccagcagtcaatttcgacaagtatggtgctaaaactggtaaatactgtgctatcactggtgcaagtgacggtattggtaaagaatttgctagacaaatggcgaaacgtggcttcaacttggtattgatctcgagaacgcaatctaaattggaggctttacaaaaagaactagaagatcaacatcatgtcgttgtaaagattctagccattgacattgcggaggataaagaatccaactatgaatccattaaggaattgtgtgcgcagttaccaatcaccgttttggtcaataatgttggtcaatcacactccattcctgttccatttttggaaacagaagagaaggagcttagaaatattatcactatcaataacactgctacattattaattacacaaatcattgcaccaaagattgtggaaactgtgaaagctgaaaacaagaagtcgggtactcgtggtttgatcttaaccatgggctcatttggtggtctgattcccaccccacttttggctacatacagtggttcgaaatcattcttacaaggttggtctaactctttggctggggaattatctaaagatgctatcgatgttgaattaatcatttcatatttggtcactagctcgatgtctaaaatcagaagatcatctttaatgatcccaaatccacaacagtttgtaaaatccactttaagaagcgttggcagacgctgcggctctcaagaaagatacgctactatgaccccttactgggcgcacgcagtgtatcaatttgtaattacagagacctttggcgtttactctaagattgttaactccattaattattccttccataaatctatcagaattagagccttaaaaaaagccgcaagacaggttaaaaaggaatagaattatcgttctcgagatagtttttatacaatacatatatatatatatatatatatatttacaagaaaagcatggcttatgtattatacttgcttatgtaccaatatatacatatatggccttattagggcaacaaacgccaaaaataaaaacgaacctaaatgagaaaaaaagagaaaaatttggaaaacaacaagaactcaaaaaaaaaaattggtggaaggaccaagtcctcttgaaagaaaatttaatactgcttttccagaatatcatattggaaaaaatattcaagccagcacatcagctacagtggaaaatagcccagatcaaatagaactatccttcgaacatgagcggtgaattagcaaattacaaaagacttgagaaagtcggtgaaggtacatacggtgttgtttataaagcgttagacttaagacctggccaaggtcaaagagtagtcgcattgaagaaaataagactagagagtgaagacgagggtgttcccagtacagccatcagagaaatctcattattgaaggaattaaaagacgataatattgtcagattatacgatattgttcactctgatgcacacaagctatatcttgtttttgagttcctcgatttggacctgaaaagatatatggagggtattccaaaggaccaaccgttaggagctgatattgttaagaagtttatgatgcaactttgtaagggtattgcatactgccactcacaccgtattctgcatcgtgatttaaaaccgcagaacttattgattaacaaagatgggaatctaaaactaggtgattttggcttagcgcgtgcttttggtgttccgttgagagcttacacacatgaaattgttactctatggtatagagctccggaggtattactgggtggaaaacaatatagtacaggtgtcgatacatggtccatcggctgtatatttgccgaaatgtgtaacaggaaaccaatcttcagtggcgatagtgagatcgatcagattttcaagatattcagagtattgggaacgccgaatgaagctatatggccagatattgtctacttgcctgatttcaagccaagctttcctcaatggcgcagaaaagacctatcacaagtggtaccaagtctagatccacgcggtattgatttgttggacaaactcctcgcgtatgaccctattaaccggattagcgccagaagagcagccatccacccctacttccaagaatcataagcattataatctatttcgctattatattacaaatgctactgcactgtcattatagcctagtaaagtatatagtgaatacaatatactcagtttcaacattatgatgggtaactccatcagaaaatatattcatcgtcatatacggaacattcagttatacgcgaaagtaaaagtgagagcttttcaggggttaaaagctgggcgtgttccatgacgtatttaccgaggtcgtattatcaaagaaaatgaaaaaaaaaaaaaaaaaaaaaaaagcgaagaggaaaaagacaaacgaaaaacaaaacgaaataacgcattgtatgctggggcctcaattgaacttctttgactataaggagttcgcttgtttaaagccgtttcgcatctgactcgcccttggtttttttctctgttcttgtttttgacctccgcaaattcattgctctttgaattttgaagagtttcacttgtcaccgttgaataaccgagacgggtattgtttttatttccttcattatttacatcgcaacacgatttttattagcttcctcaaggagcgctgaccgtatataatataatttcaacaaccgaacaaggcagtgcgaagcggtgcaccttacaacagtgctaaagtagttacagtaaaccaattaatacgtgatgaagaaggagttgaaaattcttataatagcgaacattgcattacttatctctataatacattacacatttgatttgttgacgttatgtatagatgatacttccaaagatgcgctaacagatgaacagctgaacccccccaatggcttcaattcaacattctatgagtctcctcctcaactcataccgaaaatcattcatcaaacctacaaaacaaacgatatcccagaacagtgggtaaaagggaggcagaagtgcattgatttacatccggattacacttacattttatggacggatgaaatgtctgatactttcattaaacaggaatacccgtggtttcttgacacctttaggagttatgaatatccaattgagagggcggatgcaatacggtatttcatcctttcgcattatggtggtatttacattgacttggatgatggttgtgaaagaaggctagaccctttgttgaaagtaccagcatttctaaggaaaacttcgcctacaggagtgtcaaatgatgtgatgggctctgttccaaggcaccccttcttcttgaaggtcatcaaatcgttgaaacactataagaaaaactggtacattccatatatgacaatcatgggctctacgggccccttattcattagtgtggtttggaagcaatataagagatggtctaatacggccgaaaatggtgcggtaagaattttacaacctgcagattataaaatgcataataattcttttttctcaatatctaaaggttcctcctggcatacgggtgatgccaattttatgaaaactctagagaatcacatcttgtcttgcgtggttaccggattcatttttggctttttcatattatacggtgaatttacattttatacttggctgtgctcgggaccatttaacaacaaacgctattacattcagtggttgagtgacaagttcaagttacacaagtggaaactaacatcgtcttacaagaataaggaaaagaggcggaatcctactcgtcacgaatataattcgaggggtaagagattaagaaaagattctaatatcccctacgacagcgttttccttgatatagaaaagaatcacgcaaaatttaccgacttaacctgattgaattgccactgttctacccctataatattgtgagcatggataaatctcaaaaacaatggcgtatagatatataacaggtattaaatcttagtatttaagaattacaagtaacatgcattcctataaaaattaaagagaaaaaaattcgattataaaatagtacaatgtccagaagcttggtttttaatagtatataataaagataaagatagatagagaacataactctaaactttaagagtgaattttttttttttagtttagtttttttttttttttttttttacaataatgtattgttcttggaaaataacacaatctgttcaaagtggacagaaaccctaaaacaaaaataataacggggaaggaaaaaaatagcaagtgaaacataaatgaaaaaaaggaaaattttattggttaataagaaacgatcgactatggcaaggccgcagaagaaccggacttgctcaaccattggtcaacgacatcatcgcttaaagtagcatcaaagctttcgtcgacttcgataatgtgaatagttttatcacttgaattaaagattacggcagcctttaaagtaccatcagttggtctctcgaagtaatcttgagtaccaccatcttggccgtcatggatgtgtgagattaatttatcagaaccagcggtcaaaatttcgaacaaatccatttcaccacagccagttttccaacaagaacaagatgcatcaccatattgcaaggttcttgggatttttgcatttaataaccaaatagctggcatatcttgattgtaggcagaaccgctggtgtcacttggcatagaaaattcgaagacgaaaattttatcagccccaccaaacccatgataagcaggaatgccttctctgtaataaccacaatcgccgttattaccggaacattcttcaccggagaaaatcatgaattcattaccagatttaatggtgacatcaccaagagcttgagcggaggcagcaccagaaacaccatctgaagcagcaaaagagatggagttaccgaaacaactcgaccagacaccagaaccggcagtccccccttggttgttcatgaatgtacagttgctagtagagcctgggacaaagtaggaacctctggaccagtcaccgttagtgttagaagatgatgacgaagatgatgaagcagcagcagcagaagaggtggttttagaggaagagatggaagactggctttcactcgtttcaactgcttgagcactgctggacaaaacagtagagtctttagtgtaagaagaaggaacagcaggaccgacaacggtattggtggaatcggctgtgactgtttgaccattactgtcgacgtaaacagtggaagtaacttgaacatattcaacagcaacatccctcttgtgctgatgcttatgtctggagacaacagcttcaccttccttacaggactcgattgattgtttctctgatcttttcttcaaagcattagattcaccatttgggtagtaaacaccaaattgtagtaactcgatcggacccctgaaatgaacagatagttcctcgttgaagggagccaagctaccagaagcagtgaaatcagcttgggtacaagcacaagaagattcatccatattggtgacatcttggtaggtagcagataaaccgacgttagagtaaatgatggcatcggtttgagcacaatagtaattaccgccagagtaagtacaatcagcgttcacgagtgacacaactgaagaaaacaaaccgactaatgcggtcatggaaagcttttgtaacatttttttcgttcaaattccgttaggttttagatattttatggggtgtaaatggaaaaacgaaaaggtgagaaaaagacgttctattgaaggagtgactagaagttggataagttaggttggtttgagttttgattctggagtcttcttgcgagaaaagaaataattataatataaaaaaaaattgaatggagataagaagtttaactagcaaagttcgagagatataaaaagtagagatgcgaaaataaaattaaaacaaatctgaaaataatggaagtgaaacaaggctaagcaagaaaattttctatattgccaagacaggaacgtttgtgatgaatcacatctgcattcgtggtatatttaaatgaaaatcccaagtttcgaattttcacgtttgctgtacgacgaaaaagcgtggaaaaataaacaaaaccagcactaaatcgccaacgaaaaaggaaagtcgccaacgcgaaaagaaaagaaaaagcgaggcgcagatctcgtggtatgtgatatcgtgtctaatgacttgacgtggctttttttcttgtcgccatctgcgcttacttgcgttatatcaaatataatttcagcacagcattacatgcagaaatagcagggtgcagaggtcgaagtagatagaggacaacacctgcgatggccgtacagacaccaagacaaagactggctaatgccaagtttaacaagaataacgaaaagtatagaaaatacggtaagaagaaggagggcaaaactgagaaaaccgcacctgtgatatccaaaacttggttgggtattcttctgtttcttctcgtaggtggtggtgttttgcaactaatcagctatatcctatgaagcagtggcaaattgcatatataagtgtacagtggaagcaagtacgtaaataaataagcgatttcgaataataataacaacaagcataaggcagtattacccgcgttgtcatttatggatgcgaaaaaagatgaagtaattcaagtgctattgtgatttaccatgccaatcaaacgtgcaacaaagatgagtatgaggggggacccaggcatagtacacagaaaagctttgtagactgtctttgttttcttaatttttcaagtaggctttctgcttttcttctgtacttatcgtatgctgggccgggcactaatcaacaagtatggatttttaattcatcctaggagatttgtacatttaaacgataagtcccttgatggaacatttatactaccttcgaagaaaaatcatatgtatgatgttccaactaatgatccaagcggtatcctgaatgcctcggatatcgatagaatcaataatttgccatttttcgataacaccagtccgacaaaagagacaaatactaaggaaggagcattgttgagcgaaaaattggccagcgttaaagaattatttggagaagaccctgaaaatccttcgtttatcaattacagattccccagaggtttagagaatccctattttgacattcaagtaaatcagctaaagaaaaaacgattatccgtcacacaattatgcactacgcagaattggtgcgagttaaggaatttttacgacttttattctcaaaatttgtctaaccaactactgaacttaaaatttcaggtgcagaaaggtaaaaagattcataaatcactagaggacgaaacgcatcctgaattaaatcagtataaaagctttacccacaatttccttgcactgacaaaattatctatggatattgataatgatatggatgccctgctagataactggttcaactctatcaatagattggtctctttattcaccaaaggtgacggtcatgcaagagaaatagtttgtcatggcttcattaacttagaagatggcaaactggtggagcatttgctgaacagtgatagcaagacaaaggaaaatgtgattatatcaggtgttattgaccacttaactcttagaaataggcacaatcatcaagtacagaaaggtgcagctcatcttgatacggaatatcagagctggggtaatatcctcactaatttactatcaaatctaaaagaactgaagtcgaataacgagattgttatctctgatatcaaaactaggtcagtaccaaaaataccatctattgagtccgttatagaatcctctaaattacagacaatgtattataagttttttttttcccaccttagtcaagacatgacacaaacctaccatagctttttaatcaatgcccagagaagaggactcgacgttgatgcgcccataaatcctaccaagattttaacattcatactaacaaacccactcttcgctaatgatgtgaagaacctcctgtacggactaccgataaatcattctgctttcgataacgacgccaaaggctctaatacatttgatatgaccgcgttcaatgatttgctggatagaggtcccacatcttttaacgttccgattgagcaagacgaagatagttcggagtcaacaaaatgtgtatctttgcgagattatggacatttttatacgaaatggaagacacctctaactttgaaatactttgcggcaaggttatcacagatctattttattgtgggtaatctcgtttcgaatgatttaatgatagaatattattaccataacgataatttccacaatatcatcttcccatatgatcccttgaaactgggaacccatgcccatgattctgcaatggtttggtttggtggcagagatatgcatccaattgagcctactcaaaaaaacttcaacacatactgtaagttttgtgactacagacacgtttgttcttggaaaaataaaaatgaattgaaacttattgatctagggaaagaattaaaaaaaattattcttgaatcaagtatgaagtagtgtaggtattgtaacattatttattctagttattaaaagggtgttgtttcgtgaatacattgaagtcctttattgggttattaagcacataaatctgtttctgctttcggacgtcctgtttcaataaatcggaattgaaatgacaatttaatttaaatgtatatatgcaactttcattaagaggtcattaggtattttaatgcggccttctcattcatcggaacgatgtaattgcctttagaattaaaacccaaagagaaacatgtatacacttactaactctattatgtttggatagagctccttgataattcagttacaaaacaaattatatgtatattcaatgccatttaaaaagtatgcatctacactttttttttgcaaatctttatcgctataactgttcctcttttataacatcaatcaaccaatctaaaccttcggtaataccttcgcctttaattgcactggatgctacgatagaccaacttctgtccttcaattctacaagattcagttctttggagacttcactggcacttaatgcacccggttggtcttgtttatttgcaaaaaccagcagtgctgcatcttgcaattcttcttcctgtaacatcaaatgaagttccttagaggctgtagacatacgatctttatcagtcgaatcaacaacgaaaataactgcagcagtgtctgcataataacacctccagtagggcctgatacttgtttgaccaccaagatcccagacgttcaattttaagtttttataacttagcgtctctacattgaaaccaatggttggctttgtagtgactacttcgccaatttgtaaacgatataagatggtagttttacctgcaccatccaaacccaaaatcaatatacgcaattctttgtttgaaccccatagtttgtcaaacattgaactaaaaatgttacccatcttgatctataactcactttactggaactttcttcttagatctttctttatttttcctttggttttagaaaccttattactcaccgtttcgtaaatacaaatgaaccacgcaatcctttactacttgaaagttccgagaacattctgcctaatattaattgtcgtaaatctaacttttataggcaaaatagttttattcaaaatttcaattggaaagggctctgttacccgtcctgtacgatgcagtgggttttgttattgtcataagaaatatttaacctactcttcccatatatatcatagaacacattcttagtatgttttgagagcatcaatctaacgttgcctttgtcgtgattttgtgcgaggaggcgatataagagctaaacagatttttttatattttaatcaaaaagctaataattatggcttactctttaacaaggaaattgctgaaggattggaaatattttatgcgccatcctgagaagacccaaggtctttttcatgtaaggccacatgattcagacttacatctttggcacgtggtaatgtacgagcccaggacttctttggaagtatatctactactttatattggcggaaacgaccaggatccatatatcatcatgaaatgtctgtctccaaattgttgctttccaattaacagaacggtttcgatgacacacttaaactatcttttattgaaagacttgggattacaggatttacttttccacatatggcaaccgctttttcatattcaagcaacggaagacttacagtattcaccgtcaacggtaaaattcaacagggcgtggaataggattatatataaggactttaaatcttattttccggaactgataggtactttacaaccaggtgattactctatagtaaagagctattccaaaaatcataatatcagcaatagtaatggtggcagtgtcaatgaatttatgtcctcttacaatgctcaaagccacacctttcacgcacaagacaacagcaagaacccttatactaacagcagcataggaaagtctagtatgttatctactctcaacaataataacgttaacaaaaggacacatgactacaatgctatcgactttatgaccaaaaacttacttgcatgtgatgatgacagtattcatccggtcgtaagttctaaaaggtcaagaacgttggcatgtccagatgaaacgaacgataatcgcggtagtgagcattacacaaagaggaaaaaaatctaatgggtttatttttacatagaatagtagaactttcttccttttttcacgattttttgcatgggcatttgtcacaatatatatttttattcagttatataaatatactccttttcacaaaagaaggcctaatattataggaaatcagcattaaaaacattatgtatttcttttttcagcggccgaacggtcactagaatgactcagaatggtttttatcatctcgttgccaatgagattagcctctggaagcattggctcaaagaacttttgaacactctgaaattgctttttgtatatatcaaaattggcaaaagaaacaaccgagctccattctctagccgaaataacaaattctaaatcatcttttatgaatgatttatcatggatagctgcatcaattgtctgttctaataagccaggttttaaaaaaagatattcggacacacccaggaatattctgaataatggcgtcgaacaaatcatatgatcatatggatcaataccaagttgaaaccacgaatcaacaatcgccaacaatgataaatgtgaattcggcactggcttgcaattgttgctgttaccaatgctgctttttgatagcgaatatttctctaaaatcgtgtcatccaatagtaagagaccagtatgctttccaaatacaaattgcttagcttttaatagtctatcagtaagttcttgttctttgttatctatcattaaactaaatagttctgttgcactggttgcatattgaagaatttgctgatgtgcacttgggtttgttatggctaatcctgcgtaaacatgccacttgttcgaatagattcttagtgatatattaactttcacattttctaggccaccgtaccatttgtttacacccagagtccaaggataaatctttatctttgcccacgcagatcccatacttaagaaagcagcatgtgtcacagcttgtgtatcagcggtaatcttgtcatgctcttcatatgtcaaataaacttgcttacttttcaaacatgccataacagaattaacgaactcaaaagattctgggtactgtgatctgtgattgataataactagtggttggccttcagtattaactttaggcccatgaagggaatgcacggtaatgatgtcgcagtccttgggtaaatacttttcgaaagcctcgatttccggcagcttacaactcgtttgacccccaacaattgttccaaccttagaagatggtccatacgttgcgacgatcttactaatattggatgcttcaacactatagataatatagtcgctttgcctggataccaaatgaccatttttcaccagttcgaatttagctgaggcatatttttctttcagttcatcataatattcttccctatcacaacatataacaccccatccagcatctgtaaatttattagcgtataataggcccatatcacccagaccaattataccaatgacttttgtggctttccattgctcaatcttatcctctgataccatgtttatcaagtggatatgctgtcctctttccttcaagtgctacggtattcttgtaattctaaaaacttttcttggtttgaataattccagtatcactttcttcaaagcttattttcatataaggcctcaaaaaaaaaaaaaaaaaatgacacatagctgaagtgataaacttactacactggtataacgcttattagaggaaatctaataataaactgttagctataaatagtatacaataacaatgagcgctaaaagtatgacatattaaacataaatacgcaattctacaccgcttacagcccttttctttagttgggtttctttatcgtcatcttcaacatcactttccatgtcgatatcagcttggccttcagttattacttcatcaagaacttctatagttttagtgtaaacctctattttcttgttcttctgatcttgaaaatgacaacctaatgccagtgtcttttctacagctttacccatacccaaaaccgcaacataggatgatccttgcttatgaacgctatcgagaaacttatttattcttttcagtgcactaacgtatggtgttgtagacttaacgaaaattgttgtgtgtatttgcttatgcgttagagttttcaaagatgggtgtttcgttactcgtttggtagatttgttgtgtgtattctttttgagtgccatcctgggtgcagagttctcttttcttctttgaccgtcaatcttattgcttatttctgaatagttaagtagctctttacagagagtgaaattaaacaaatggtcaaacaatcgcaggaaaaaaatgaagaaaaaacattttttcgaaatgacatgagaagactattgatgtacttctcatgattattcaaccatattgagctggacagatttttaccaaattgatttgggaattttagacattattgttgtcataccattttcatattcaattcaacagcctggtggggaagtaaagaaattatccccgaaacaaatacccttttatgcttatttccaagaattactggaacaccaactgcaagggtaaacagaattgatgaagaaggtgcaatcactcgaaactacttcatactttctcttttctttcattgatcttaatttagttcagtggacatcattttgctaatttcaaggaaagaaatggacacaaattctaaaaccaaagtacaaactgaaaataaaaaaattaaggcgaaatttatacataatcatgggcaaaagccctctcttatccaaattacacctccaatgatttccagcactctgtttcacgcatatccactactactaatattcgacaatgccttagcgaatataatgtggctgtccgacgataaatgtttaacattcatttatctaacgagcatatggctgaccataagtttttttatccccgttgaaacagaggctagccattttctgccatttacaaagattttgagactatggttaggcattataagcggggcatttctattcttatcattcatgtattatattgtttcattgatagcttcgttaagagacacggaacctcctacattggatgaaattgtcgtgctactagagtctgtgttggataaactggaagtactgagaaacgagctgaatgtttggaaaaaattaaagctttcatttgatggcgtcaataaggagtgttctggcaagaggttgttttgcagattattcttattcggtacaatttttcaaattattatcatgagatacatatcaccgggaacttatactagattttttattattaccggcttgatatacaatacgagtagttttcaagctaccttaaggctactttggaggtttactgctgttaggaatttctattatttggggattgaaagttttaaaatttcgagtttcttaccaaaacacttaaagatggaacaaattattcctttatctcaaggacgtgcaatcacggtgccactggtagaggtattgcctaaactacttcgggacaagaagggtgatgaccacattcatattctacagcttctacttaatgagcaaaaagataactttggtaatgaagaccttaaaatactagaaattgaagtatacgaaaatcaaagaaggtggtatcaaaataaaaattggagtacaaaattactgccgtacgaaagacaaaactactgcatagaaattaaaaacactgatggaactttaaccatgaggagttgtttgcccccagatggacttggtgaagaagaattacccaataattggcattggatcaatgataattgggacggaactgattggatatattcagattcagcatggaaagaaattggacaatacagttctttggaaagttttaccaggtcaagaaaatggaaacgacgcctcttccatttgtaatagtattgctttaagcctctaaactgcatatatagttggttgcctaacattatcatgatatgaagaattttctcatactttgaaacataggacaagtaaaactttataagatcatgtgcactttgtgtatgttatttcataattttcattaaattcttataacggcttatgtagaaataattatcatttttataatagaagattgaatatagaggtaatgtataaagggcacataatgaagcactagtggttcatttaagaaagaataaagagggaacaatccaaatagacaaaaattccgattaatcaaggtccatgttttcatcattgttgtcatcgctatcatcacttgcagcgcgtgcccttctttgctcagccaatttttcagcaatatcattcattttagaagtttcttgattcgctctgagtgcttgtcttttttcttcctcctttgctaaatatctacctctaataatattccccaacgatgccagctcctcatatttagcaatgtattttgccttggtagaatcgtcaccatcaccatataaccaattttcagtagtggctaacatgttttttagcttttctttttctgcgtcagacgcaaaatcggagtattcatcatcgagtttggcacgaagggtataaatatactcttcaagggcatttttgcgatcctcggtttcggcaactaacttatcctggtttcttaattcattctctttttcaattagatcgttcaactcaaccgggtttagcgcgaatgtttttgcagtcatacctagcacatctttcttaattgttttagtaacttctttaaactggggctcggcatcttctggtgcgtcttccggtaaaggcactggctcttgaaccgtaatatcttccgttgtgtaagcgttctcgataatatgcaagccggaaggatcgcatcttaacttgacctttacaggaataaaatcttgatctttaggaaccttgaccccagtgaagctccattttgcaatagtggtggaagtaccttttggcagtttcgaaggatgagtgtacaccgctttcatgctgaaatctccagtacgatgtaaagtaattagtttagttgatggatatgatgaattagcagggaatacttccaaacggtcttcgtcatcgacctgcttatcccaagtgtatgacactgaatacggatcaatatcttcaaatttaaacggcctgacccttaaagttggagagtgaatggcacatatgaaagcggcccccttggccacagcttcgtcttgatttaaagtagatgacaaaggttttccaaaaacatcagaaattgacttctttaaaactgggatacgggttgtaccaccaattatttctacgaagtcaatatcattgacagttaatttagcttgagccaatgcattggtgattggatacgtcacacgcttcaacaagggctctactaattcttccagctcttcacggctcaattgagaggaaacgtcgatatcatccataacagattcaacggagaagggggcagtagtgttcgcagaaagcactttttttaatttttcagcagcgattaaaattctgttataagctttcggatttttcctaatgtcaatcttgtacttgtccttaaactgatcagcaaaatgttctgtgattgcgcgatcgaaatctctaccaccaaagtgcttgtcataagcagtacctaatactttcatttcgcctttgcggaaagccataatagaacaggtgtaggtagaatgcccaatgtccactaagccaatgattcttggcttttcttcaggacctggcagatcattcttgaagacgccgtacgaaacggcggctgcagtcacatcgttgacaatccttacaggatttaatcctgcaattctggcagcatcggctatgttataacgttgttcttccgaataccatacaggaactgcgaggcagacatcggtaattgatgacttcgtttcctcttgaacggtgtgcttcaccttatcaatgaacatagcagtcagttgagtagctgaaaatacgtgtgttttaccgccgaactccacttccacaccaactttaccattttttagctgtaccaatttcgaagtgaagaacttattctcgatatcaaattcagggtctttgaactttagtccaatgattcttttcaagttttccacagtgtttttaacattcgatgtttgcttagttttaccagattcacctaagtacctatttctggggccaaagccgaccaaggatggtgtagacctattagaaacttcattgacaacgacatcaatacccctatttctggcaactgctagtactgagttattgttacctaaatctaagccaaatggagtgctcattatattatatcctttggttacgtctgttacaggtaaaaaaaaaaaaaaaaggaagttttaagggatatttccaaaatctatatacaagatttcataaataaaaatctctaaacggcaaagtcctttggtttatatcaagagtaccttaatatataccaatttgtaaaagcgactcccagttattgttccttaaaactcctcgtatgatgtgatttttggtaaggggacgttctagaaacgtctactattttggatgatttacatagttttaaaataaaaaaggctcaattttaccttccgcgcatttctatttttttaatctaaaacctcaaatcttacagtctctcctagccgctttcctgaaggatcatgactaacgtttgccaaccagccgatgagacaagttttagtagagattcttcccattcatttttcacagcagattctattagtaacttccattcgtctggagagagtatctgcagagaatttatgtataatagtaaatgaaagttcgagattttttcatgcaaaagattgaaatctccacttgaagccacattgaataaatacttttttaattcttgataatcttgagattgccccatagcttgtcgattgctccatggaaatccggtggaactaacgaatttcgagttggtttccgtatcggtattcgggaacccatgagtcagcgtcactaaaagatagtctaccggaaatgcaggcttcgcattttccttcactgttataccatattcattcgacttcatgtaaaatatctcaggtacatatctttcatctgtagtgtcattaatatatgccattgaaggaaatgtggacccacttatcatatctgcagtaaccaatgcttcagcttctgtggatacttggtagctcgaaatatcaatttcaccttccaaattacctgatataacgcaagttacaaacttggaagaaaaaaaaccttgttcgctatacttgcttacattaggatgccttgtttgatgcctagcagccataataacttctaatgatgaaagaaaaaacgaatccttatgtcttttgcaaaaaacagacccatccccagctcccgcgtcagataaatctgtaaatattaggccaattcgcgaaagccccatttcttgagcctgtctatcaatctgtagcatttcattcttgacctgttctacgtccatggttaaaccgtcttgctcatcatgctgagggggctcgtatatcgcctcaacgacggcctttatacctaaaggtgtgttatcatacttagaataagatccgtacatatagccaaatctttgcatacccgtgtacctccacgcctgaataaattcattaattatttcactcttctgaaattcaacgtggtcaaccattctaaattcttgctgttgtaatgtaattgccgatggttgacatttagaacatatcccccgaggccatggttcatggccattatggcaacgcttattgattctaaaatcaggttctgaaagaggggaaatataagagctgccgttctccttcttattagcattttcatttagctttttaagatatgaatgaaacgatatatgtttgatcttattcttctcatgatattctttgtcccaaggaggtaaaggcgagcagtattcacacatacctctatcaccgtgcttgcatagttttgatttttgacgaggaattaatccgtcctctttctctagttcctcatctacagcgagttctttgatccttagtggaccgtacctgtgttgacgaattcccttgctgtcaatacctacggatccgatttcaacattgacaccatctttctcattagcgggcttgtccgaatagttaaggatcagcatgtcaccgtgctttagtcctagatccatcactgttcgatcagctagttcagaaacagcatgaataccttgaccgggcttctcacaaacagtaaatgtgtcgacatcggcattggggtccagattacccaccaacttttcaatgaccgttccgaaaaggtcgttttcttgacaagaaaccctgtgtgtaccgttttttgatctaaatctgataagcatacttcacttaaatgtatatcgatatcagtagtatagggaaatttttcttcagagtactgtcctattatttgccactcttcgttctgtatgttacgagggcgttccttaaaatgggtagacgcatcttattacccgccaaaaaacgtcaaaagttttaggaacacgtctaaaagttgaaataatatgtgaaaaaattgatgaaatattaatgaaatggcttatttaaacgaattcaagtacaggaaagaggtacgcacaactacttgagtttgccaatatgtccgaatttaatgaaacaaaattctccaacaacgggacgttttttgaaacggaagagccaattgtggagacgaaatcaatctccgtttataccccactcatatatgtctttattctggtggtgtcccttgtgatgtttgcttcaagctacagaaagaagcaggccaaaaaaattagtgagcaaccatccatatttgacgaaaacgatgcccatgatctgtatttccaaataaaggaaatgagtgaaaatgaaaaaattcacgagaaggtgttgaaggccgctttattgaacagaggagcagaatctgttagacgatcattaaagttaaaagagttggctcctcagataaaccttctatataaaaatggctctattggggaggattactggaagagatttgaaactgaagttaaattaattgaattggaatttaaagatactttacaagaagctgaaagattgcaaccgggctgggttcaattgttcgttatggtttgtaaagaaatttgctttaatcaagctctctctagacgttatcaatcaatcttgaaacggaaagaagtgtgtattaaagagtgggagctgaaaataaataatgatggaagattagtcaattagtgcctactgtgtgcaaagatatgtattcgctcgttcagtgtttttttaaaaatatgtatagaatttgtcattatctgcgttaaaaaatagttataaagtatatacaataacaataaatgataaagaaatatgcagtgaaaagaaaaaattatgaagcttttcctttcagtgttttctacccttcttcttgctcactacttggaattcccagccgtcgtcatcattgcctgatagagctagcgcttcattccaacttagtggatcatcaccttgtttttcgcacgcaacacgtcttttaataaattcagtggcaaatcttctaccatccataacgtcactattggcataaattgtttcttgaatcaattctttagattctggccccgtaggtaaactcaataatagttctaagacattgttattggttattccagaatttaatttcatctgtgatttacaccatttgataaattcttgccggggagaaacattgttcatgctagcaaaggtagtggtagtagaagttgtgctagtttttgccgttaatgaagaatttaaactggtattggtttttgaatatggggagacaacggttcctataggtgctttccctttagaagtcaccgtagtccaagaagatgtggtagtagatgcagaggatgtggactttacttgtttggaagaactctgaaccttttcccatagttttttctgctcttctatgaaatttggatcttccaactcctttaacggagacgactctttcatcccttttgggcttttttgaaactgagatttaatatcaatagtttgattcgatggtaggctggacttgttagcccagttaagcacggattttagttcctccttttgcttttcttctttgctgttcctctgttgtagacctaagggttctcctttcttctttccagtgctacttacaccatttttaattgaagtttcgattgcattgttaactttgacttttgaggcccatggtgccggattcgcgcttgaggaatttaatgaaggcaaatcttttgatgtcttaaagccttctgtttgtgtttgtgtgtccttttttgtcttttctgattttttttgcttttctgcttccaaagcttctttttccttttgttccttttgttccttttgtttcttcaataaatcatcctctttttgcttttgtttcttcgataagcgagcttcttccttccttttgagttctctgttccgtttctcttgttcatccaataacgcttttgctacagattcggatttttccttcttccctttttccagcatagtggtcgatttgtattcttgcttgtgagattcatctgtttgactaatggtggttgctgaggctaatttaatatcgactcccttggaggtggtacctccatccatatcccagatattgtcatgtgtcaatggcttgaaaatatcgttttcagtagctttaatagtgccagtagcggcaacaccgcttgcgtaaggagctagattcaagttgatagaatcagagctggttgtttgaacgtgaagtttgtcaaaagtagtgaatggatccgtatcatacttctcgagtttagtcattaactcaccaagtgtgatgaaaatatcgtttattcctagcgtttctggagtgcttcccaatcttgaaatctgaagggttgaagcaaaatagccacctatgtaccattgtgacatcatttgggtagtaaatggaccatgaatctgtccctgcgtgtctatgtacctccaactggattcaactgaaactggtgctgggagttgtgacattccgttcatgctcatattaggaggaatatcagaggacggaaacaaattgacatgagattgggcagcagttggtgtacttaatggagtaatatctaccgccaatgaatgtgtactcagattcactccaagattagcagcataactaaaggaggaggaggactcgtttctttgcaatagtggatgctgctgaacaggcgtactaacccgtgattcaggatggtcgccgtgccaaaaagaggaactcattactcccgaactttgaggaataaaaggctctttcatagaagaaaatggtgacgcagcacgctgtataccaatagaatcgattaaggaagacgtcctactgagtggatgtcgacctcctaaaagaggtgtattggatctaaacgtcgatccagggactgtattcacgcttgcagcaacagcaccgtttgtattgttattaacgctcgcaggggaggaatccaggatagtagaaacaccgtgtgtgttattgttttctgtatcgactgaatctagttttaagtccttaaactgttcatcaaaggaaccgaataatctttgcgagtctggtgctatcattattgatgtgggctgagaagttgagtatataggggaggaggaaggaaggtaaaagctcaaggagtacgaatggaaatgatgaactcgaagagaccactgaactgcgtgtgtgggtatttgtagtattgtgaaaagttccaaaaggcccatcaaatcaaatcaacctataagtggaaatatgaaaaatttttttttttttcagtgcgactgaaaaaaaggcatagggtaattgcggactatataggacactaaaaatatagtgtggcacaactatgtagtataagtattacggcactaatctaatcttttcaatggtttacgtgacagatgtataaagaaattgagagcaatttttaaatgcctaattgtttttcgattttgctgtggacgtcatcacctaccatggtgctggcttgtaggccagtaccagggtagacgtcctcccaatcgatgctgcactctttgttcagtagtatgtcacggtgtatactaccgtttgttgaaagggggttgaagtcggtacgattgacgatttccatttccatcgtccttttcattggttcggcaatgccaaatatttgtcgatactgttccatttgtctttggcgctgtgtggtttcccagttcttcaatgttgattctaatggatgtctgtcattcaattgtgtggaaagaggtactgcaccgccttcttgctggcgtaatgtgtctggcaaggagggcactgcagatgaaagaacacttttgtcttgatctgtagagacttgagatttaaaggtatcttgtgggacgatattcatagttggtatgcaggctgtttctggtcttgtctatttaatactcattccctctccagtgagcaggaaactacataatatactttaataacctcaggtaggataaaattgccactgcatggttacccgaggagtgaaaaaagcaagaccataagaaatgcttgtgcatcactggcggtagatattggaaagtttgagcgtaggctcattcatttgcaagtggccattatatgctaacatgttccagtttgttactcctgtgggaacacagaatggattgaaagctacttgtgcgaaaatatctcctgatgggcagtttcttgctataacacaaggacttaacatcctgatatacgacattaacagacgaactgtatcacaaacactagtcacatcacatgccaggcctttctcagagttatgctggtctccagatggacagtgcatagctactgcatcggatgatttttctgtggaaatcattcatttatcttatgggctgctgcacacttttatcggccatacagcgccagtgatatctctgacattcaatagaaaggggaacttgctgtttacatcctcaatggacgaaagtatcaaaatatgggacacactgaacgggtctttgatgaaaacaatatctgcacactcagaagcagttgtgtcggtggacgtacccatgaatgattcatccattctgagttcaggttcatatgacgggctcatacggatctttgatgcagagacgggccattgtttgaagacattgacctatgacaaggattggaaaagagaaaatggtgtggtacccatctcccaagttaagttttctgagaatgcaagatatctcctggtgaaatcgctggacggtgtagtgaaaatatgggattgcatcgggggttgtgtagttcgtactttccaggttcagcctcttgaaaagggcgtactgcatcattcctgcggtatggacttcttaaatcctgaagatggatccactcctttggtgatcagcggttatgaaaatggcgatatatattgttggaattctgatacaaaaagcctcttacagttgctcgatggttctttatatcaccacagcagccctgtaatgagcatacattgcttcggtaatataatgtgttcccttgcattgaatggagattgctgtttatggagatgggtttaaagaatctgcgttatgtacacgacagacattcccttaaggtgtaacacaagagtatatatagatatattatagacgtttaaaagttttaagggatcggattttcagccagatattttttactttattctaatttttttttttatttttcactgctgctgtcttgcgtgatgagtaagatatcctaaaaaactactaagggaagttcgggcagctttcaacattaagtgttcacatctcgaagaactcgcgccttaaaccagcctatacaaaagcttagtacagattacctactgcattgatagctagcatctgtcttgttaataaattagcttgccataaaattagggaaatttttactcacaatatgaatataatgaaaagacaattatgcacctcctctaagcgatttttttctacagcaaaaaacgttgtcaaatataatacgattcaggatatcaggaacaaatattttactggtacgcctttgtcgatgtgtactgcgtatgacttcattactgcaacatgggttaacaaggctaattgtgatttactcttagtcggagattctttggcgatgacttcattggggtacgatagcacaattacactatccttgaatgagtttaaatatcatgttgcctctgtgtgcagagctgaaggttcttccatggtagtggtagacatgccattcggtacgtttgaatcgggcatatctgatggcttgaagaatgccatagatatcatgaaattggacagtaaagtcacctcagtcaaagttgaagtcggttcttacaccaaagacaaatatgcaatgaaatttattgaagaactgtgctcccggggtatacctgttatggctcatataggactaactccccaaaaagttcattcacttggaggttataaagtgcaaggtagcaaaagtctattacaaatgcaggagctgtatgaaaccgccatgcaactacaaaaaattggctgttggtctatcctgattgaatgtgtcccccataagatggctcagttcataacatctaaactctcagtaccaacaataggtatcggtgcaggtaacggtaccagtggacaagttctagttatatctgaccttctcgggatgcaaggcgattctgtcccaaaatttgtgaagcaagctgtaaatatgacagatattgccactcagggcttgaaggagtacattgcaagtgtagaggataggacatttcctgagagaggtactcatactttcaaagttaaggaggacttatggaatgaattcctctcttcaattaacgaaaagtaaaatatatagataaaaatcactgcatagggaaaaaaactttaaattttaggtatactgaagacaacaaaaaatacataacttaaaataaaggggcattgatccaatgttgtataaatacataggaaagtggtttgaaaattgtgtgacatcatacgactaattcatcaaacttagtgaaaaattctgcaattgccttggtagcccacgagttgttgtctttatctaggtaagctaaatgaccacctaaatcggttctacaatacaaaatacgaggattcttttccacgattgagtatggttgatctgggccgacaacaggatcatccctggaattgataacaagggtaggaacccgaattgtatcaactctgtttattgagctggccgctttataatactccatagcatttgggaagcctaaagcaggcgcagtgtacacttcatcaaattcccgggtcgatttaaagctctttgcctttattagattttcaggcgtgaacatatagaaagatggattcttgactgtgggaggatgatcggggagagagccatttggaactcctaattcacccatattaacctgaacggttcttgttaagaattgcgcaatatttttggaaaataaagttcttgaccaccaatcctggctcatcctaattgctgaaaggagaagatcccaaggattgcacaaagtagcagctgcggataaaggtgatttatcgccctcttctcccagatagtttgccagcatcgtagcaccaaaagagcatcccacagcgtatagttttctatctggatgtctttgcttttctctttgcaaaaactcgcgaatatccattgtgtgataagctgtaaataaatttctggtggtaattttggaacgtgcacaacctctggtatttaggacgaccacttgaaatctcccactgcgagacaggttttcagcaagagatcttataatcggctcatgactaccaccagcaagaccatgtagaataactactaggggtagatcaacctcccgtagttcttccaactcattatctttcaggtaccttgtacgtggttgtaaacgaggccatccttctggatgtgtcgccttctcgtctttatcaaatttttttttatcaaagctcgtagtactttgatcgaattcataatcctttttccatgaatctatgagccagtcagcggtgcaaactccaccatccgagaatttgacaatttccctgccgtagaatacaggaaatttcttagagaaatcagcagcacctaagtacaaagtttgcaaaatacctgtgaacaagtaaggactcaatttgaattgggcaccattcttcaacgttgggacatatttgttagcgaactcgtcaaaatcaacttgctccttgttgtcttttaaatggagtttaatggaaccattttcaccgacaatatgcgaaactgtaccattgtatccccaatggaatgggttgattgctggccatttggaaacttctgacatatcggaaacttttatgagctttgttttttacgcaactactatcaatgtaataatagaacttaaaaaactgctcatattaataataaacggaggaaatactcgaggagctattacttccagggacatccgatatctgacgccttttaaaatctgcacatgcgcaagatttaaaaaaaaaaaaggatctcggaaccggaacgagattgctcatttttcgttccgtttccgcaggttttgcaaatcattaagcagatacacaagggtccttttaatgtttatgtaatttcgtgcaaagtgaaaaaaaaaatggacctgcttggaataaaataataagtaacattatgtatattgatttgaaaagacctcatatatttacaagaatatctaatcgatgtctaaatttatttcttccaccatcaatttttgagccacggttccttcgtatagagattggaagaatttgattgacaacaagttactttcttttttgttttccaattctttcttagtgatttgttttttatccataattatttcacacgaccttagaatttcacgtgtaggtacacgcaaaacatcacgtacttcatttgaggttctttgagcgttaagatgaatgtaatccagttcttgcaactttcttttgtatttaatggaaagattcattggtaaggcacgggggaggtcatgaattaaatacgtaagtcccaacaaggaacctaccactataaccggaactgataacttcttgagtgagctccacgacgataatttaatgccgtttaatataatgttccccacaacctttgtacttcctagaaagtacagcgttagagtgggaatttttgatgtgaagagcaatgatggtcttgaccaatattgtgtcaaaggataatttttcaaacccaaatacttcattaggccaatctgaccctcgttagtttgtccttctatatccggcagtggtgctgtgacaggtttctgccagcttaagtaagacaaaaagcctttccaagttggagcaaacaaatcagttattgacaaagatactttaagcctttttcctatcaaatgcttcctttttctaaacattagttcgcttctgaaaacacgttcacacatgaaatcatcaccaagttcattttttccaatctcataaattttttttaccagtaaatctgtcttttgcttggcaaataattcacttgatcctattgactcatcaatctgatttgctatgaacgcttctgttgaaaatatgaagtcataaatttgaccgaggccctgatatttcggatattcgtgtagcggaacatccaacgcattgagaagtgcttctttagtattgttataagtcattgtaattgtttgctcggccatttgatcaacggaagttgttaaatcattgcactttgctctagcgctcaaaatttcaggtctcaatgtttccagttgttcgttaatttttatttcttcttcactatacattttcatattagatttggagatcattattatatcgcttaataatttcgatagataagtcttggcaggtaacaatttagaaagtgatcttttcttcaaaacaaaattgcgtagagaatcttccagactgtcaaaatccggatcgggatcgctgctagaatatgggtcgtcgtcaggttttcggtcaccatgatcttcattgtcattttcattatgataatgtggcaattcatctccgtttttggaaacaaagtggacaaaatcagctgcacgtttatatgtttctggggacaggtcacggatttgctttaggatcaactccttacaacgttgtttgtccctgattttgtcaaattttttcacaacaaaaaacattaattttttctcacgagatgctaaagaaataaactccttggcagatagtgttagctggttctctgcattgacaacaaatataactaagtcgatttcttcttgtcgggacattacttcggcggtttgtaacgagtccatgttcaacccaggggagtcaattaatgaaatatcaacagtaccattccttaatagactagtagaggcaggccttttatcgtcctttatgtaaatcttcagtaaagcatattttccgttttggggaaccaaatcgggaagttctttcaaagtgtgtatttcataagtcttgggattttgtattgaatacatatcaatggcttccttgagagtcggagcaatgtttagtggtatggcatgaacctcctctatgccgtcattttcccgagcctctagtatttcggaaaatacattggtacatggtagctgatcctcaggtagcaaacgctgctttaatagagagttgcaaagagctgatttaccagtatttacatcacctgtgatgaatactttagatgaaacgtcatccactctttttttcaaagcgtttaaatgatttgtcactgatacgatctgagagtgaaataattttgataaagcttttttctcaatgttgaaaccgttcttttctttggtattgtactgaccatctagcttgatattcagttgtagaacatgtaatttttcccgttcatcatttgcagcaataaaaatcgggcgaatattattttcttcttgaagttgatccataaaagcttgtgtctttaatatagatctttttaaaagtactctattgttgttataattccactggctaagttgtgaagaaattaagtgtgcttttgagttggaggaacgcaatgagggcaacaaatcatcctccctacgcccctcttcaccatcaaacaaagtggtacggtcatcagttactccatggaaattactgcctaaaaaatgaccttcgttgcgtgagtaagtaagagtttgtggtactattgtggcggcatcatcgtcctgatctgtggagtccttgtgcggtttattgctgtctttgaattgttgttttccttcagacatcgttaaatgagcctaccgttttgcctctatccgtgatatcagataatgttgctatgttcggatgtactttgctttatttattaagggctactgtaacctgcgttatcctgtttcaataatgcatcgtccgtcttaattaatattagcccggccatattcttcagcatgaaaagctgtatttacccggactgcgcaccaacttttaaatattaatctccgttcggtctttgcgcgagttattatactagcgccacgtattagtaatactatagctatcttgccagataagggatcacaaggaattatataccgtggatcacaactatccatatcactcttcccaatttcgcggagaaatacttatgcaggtttccaaatcatttccgtagccaaagctgcctgttggccactgttttggcatctctctacatttttttttttcattgatactttcaacccagacattctgtcacctggtgaaaaacgacacaaactcctttgtaacaacaattgcaattttaagatatatgagaatattgataaggctagaaggatggtagtaagaaaagttgttgttggtaatttttcaaaaaagagtttcaagagctgggaaaagaattaaggcaatgggaagcgaaccgtttcagaaaaagaatttgggtctgcaaattaattcgcaagaaagtggaacaacccgctcaacatttcattcgctagaagatctaggagatgatgtaattaatgaaagctgggatcaggtgaaccaaaagagagccaatatagatcatgatgtctttcatgagcaccctgactcttccccatcattgtcagcacagaaagcaaaaacaaaagaagaggaagttgctgtaaagtcatcgaactcccagtcaagagacccttctcctgatactcaagcacatattccatatacttatttttccaaggatcaaagactaatcatttttggaattatcatttttataggatttttgggcccaatgtctggaaacatatatataccggctttaccattgctgcaaagggaatatgatgtaagtgcaacaacaataaacgctacagtttctgtatttatggctgttttttccgttggtccattgttttggggcgcactggcggattttggtggaaggaaattcttatatatggtgtcgttatcactaatgttaattgttaatatacttttggccgctgtaccagtcaatattgctgccctttttgttttaagaattttccaagctttcgcttccagctctgtgatttctctgggagctggcactgtaacagacgttgttcctccaaaacacaggggaaaggccatagcgtatttcatgatgggtccaaacatgggtcctattatagcacccattgttgctgggcttattttaatgaaaggaaattactggagatggctttttggtttcacttctatcatgacaggaatagcattgatcttggttactgctttacttccagaaacgctacgttgtatagttggtaatggagaccctaaatggggtgacaaaaaagatgaacgtgaaaataacgaatctccattcttcgaaggtaataaaatatcacatcggcgtctgttcccagacattggtatccgtaaaccagtcaataatgatgctttcttccaagaaaattttccaaagccgcctaaagcaggtttgacactatattggaaaatgattaaatgtcctccaataataatcacgtccgtcagtactgcactcctgttctccagttactatgcgttcagcgtcacgttttcgtattaccttgaacatgactaccgttttactatgttagaaattggtgctgcttatgtctgcccaggtgtagctatgttactaggatctcaatctggtgggcacctctcagattatcttcgttcacgctggatcaaaagtcatcctaaaaagaaattcccggcagagtttcgtttattactgaacctaattggaattttactaacaatatgtggcacaataggatacggatgggcaatcttctttcattatcattttgtggttcttttagttttttccgctctcactgcctttggtatgacctggtgcagcaacacatcaatgacatatttaactgagttattccccaaaagagctgctggaactgttgctgttagtagtttctttcgaaatgtgggcgctgccattagttccgctatcattttacagctctgtaacgcaatgggaattggatggtgttttacagggctcggtctctgcagttcaatttcattgattggtatattatatcttctcatttttcaaagaaaatatactgccaaagaattttaagaaatagtttatgtttagctataaaatttaacttttagaattttattatattatttaactttcaagaaaattttctcatcactcatcccaaggacttcaagaaatagaacaatgcatcataagtttatgaattacgtgcatttggaccttcaaagaataaaatcgaagttatagttaattatattaaattaagccaaaagtacatatatctaaaaggaaaaagtataaaaattatgcaggtccaagacatacttaagccttcaaagaagaagctcttctctttctgatttcggccttttcagcctttctttcagacaatctcttagccaacaattgagcgtattcggcagcagcttctctttgagcttgagcgtttctgaccttcaaagctctttggtgtctctttctttgcaatctttgaggagtaaccaatctttggatctttggagccttggtgtaagtcttttcacccttggtgacttctcttctgatgacgaaatcacgaacgtcatcttccttggacaaaccgaagaactttctgatgttgttagctctctttggacccaatctctttggaacagtagtgtcagttagaccttccaattcttgttcacccttcttgacaatgaccaaagccaagacagccaaatctggaccaacaatggcacctctgacggactttctctttctttcaccatcacgtcttggtctgtaacaagaaacgttcttggtcaacaacaacttgattctagttggcaacaaaacaccttgcttcattgggaaaccttgtttgtcgttaccaccagagatcttgaagacgtagcccttgaattcatcaccaacggcttcaccatcgacttcttgaccgattctcttgtcgaagaaaacacgaatacggtgttcatcatcaatttcgaaggtcttttgagacccgttgactgggtaagaaatgttcaactgttataaataataccatttgttagtaaagttgtccgaagccaatatcgacaaattccaacgaatccctgctgtcctttcttccgttacaggtttttcttattttcattgatatttctaaacccttttcgtaaattcctttttcattccttaatttgaacttagcgagatattttcctaagtgtcggtacgtgtatattagagggaattatctcgtttaaacaacgttgttcttgagaatttttattatagtgcactaatttgtgggtatacgtttatcaaacagtcagaaacagccggttagcgcgtgctgattcattagaattctaaggatttgggtgatattacataccttcatgatggctcagtcgtctattcacactggatagtttcaattaatgacttccaaatgttttgaagggcacactattcaaattaagatcacttttcataaagatgaatttttctcccatcaggcattcattgaccgtgccctacaaaccaagccagccgagattgtatcagctccacgcacataggattttcgcctgcccttggcccataccgaaagagtttcctaggatgatgggccggcatgaagataagcggcctgtatgcccgagacactgaaaaaaaacagcaaaaaaataagatgtatggagttcaaagatgtatggatgcaagaaaagaggttaatggtgcaaactgtagaaaaaaaagtaaggaaataatttatttttaataaaattaactgaaaagatacatgtatatttttctcaaattaatcaatgcaatatgtgatatatttgctatctggcttaatgagataattttttacataattatgttgagaagttaacagggcagtctctattgttttgatcgattgagtgcacaaaaattggaagggggccgtggagcactacctgcaaattgctagaaatttgcgtcactacatctgaaaaatgtacgagcgacataattgtctatagccctaatttagaagacgtttgcctaaatgcgccaacatacactcttaattttaagcgaatgctttcttgtagtaaaaagtagctagaaagcgattcattaatctggagagtttgtcgaactcgtggatttcaaagttgaactagctaccgaggaaggaaaaaccacaatagatgaagacgggcttttcggaaatttaggcggtcttccaattggcggtttcagaaagaatgttttgttatttacataagtgctgccacatcggccattatgatataagtcgtccatatcattgttcttgaatcccaaaaactttgaacgagaaagaggggaggacatgttgctggcgagcatttgattgggagtggcttgtacatccgttttcggtgatgcggttcctgaatacattgctggcgacctctggcaagcgtcatttgtggccttcggaatatttagctttaaatatggcttccctgagagctttcctctattgctgttcagttggtgcaggtgatggaccatcgcctgcactggagctggaccttccaaagtatttgatatagcaactgtcgggtgtatcttttgctttgcttcaaagctctcgctgtcacccgtcccattaaatccttttcccattgggttactatttgccggaataacctgtacaaattgcgattgaaaggatggaatattgcccactaaacttgcaggcaatgaaggctttggcaaattctcgtaaggcgacgggtaaaaattatgataattagagtggttagattcagaaagtagtaaatgagtatccggcctaatcctcttgttcataaaattcctatgaatagcctcgtttgcaacatgctgttggtctacgctttctttataatcattagcatgaaaactcccaccagaatttaaaccgccttgcaacatttgataatctgcactatttcttgcacagtcagaatgattggatccgctacgtgatattgctccgtggcaatgcaccaatggtgtacttacaccagcgttcccggcgtcatttgacgccaacggagcgcttaaattcccattgttttgtacactggaggaatcttgactcgaaactgtacaactcccagaatgggaagctggttgcaacacggttgctcttcttcgcctgcgcttcctttcattcagaacaacacgtggttttttcacatagtcaccataatcagatggttctatgatattatgaggaagatcagtgttgttttgatgaacattaagcaggttactcatatcaacagaagagtattcgtagaatgtattattggatcctaaaataatgacagcaatgtctacttggcaaagtactgacaattcatgagcctttttaaatagtcctgcttttcgctttatgaaagtaactgtacgatttctatcatctttgataggttcaatttcaatttttcttctacccatttagcagaaatttttttgaaaataattgtgtttgcttatctagagctttattaaatttttttctgatgagataggcctgctcgaaaaaatagtctgtctttgaatttggctcgtatatttctcccttcgaatgaatgataaagaaagactcaaaggaatgatgtagtgttatatagattggctaaaataatttggcaaaagaaagatggataaggatagttcatgtttttgagtccttcacgaacataggaagccgggtatgcgtggagatttaagttttgccaagcctccaattactcgagcgagattatttttgcagaagaaacaaagacgccgcttgttactaaaaaaagaaggcaacaataatgcaaaaagttcgaaccaactgtacctcaagccgttttgtaagccactatcatcgggaacggtacaggtagaatgatagatgaaatttacgtaagcgttaatggaaaacaataacgatgtggtgtaaaagctagtgcgtagtgtgagtgccactagttttctttgacagcttaagagcaagcttttggagctcacaatcaagtgaaacaagaattatgttcattttctccttcggaactgcagaataaaaattctttatactataaacaccgccattatcaaaaaagtattgctgaatcatggtatacagcgtgaaaatcttcatggcatttctacaaattctttttagttagtatcgccaaccattaacctttttagtaatgctgacgttaaacgaaggcgaaaaaaaatacttggcaacaccatcgtttatatttttttcaaatggaagtgtcggccgacgtagcatagcaggaaagattcaaaggcaagggtttcacataacgttacccttctgaccacgccccttctttcgatcccactagtgcggacggattatcacgcaagttttttaacgcgagacatcggaaaatatttatgccgattagatccggcccctgaaactttttgtttgatactttcaaacgcactactctaccccatgacataaaaaatatctgtctccggttatatatgtctaaatagaattcgggtagcattttatttttatcgcttataggaaaaagatatttgcatatatatatctatatatcctatatacatctatatagttattgtgtaaggggtttttataaggtccgatacttacagagattaatttgtaaataaaagcagaaatctttatttaagaaaatagaagattgatgggaatatttcgttggaactatccagagagttctgtccccggcgtttggggagaaacaacttccactattgactggtgtgaggagaactatgtcgtttctccctatattgccgagtggtcaaacactttaactaacagcgtattcatactgtcagcgatttacacaacttactctgcttacaagaataaattagaaaaaaggtttttacttattggcttcgggtacggtttggtcggagtaggatcatggctatttcatatgacactgaagtatagattccaactattggatgaacttccaatgatatacgccatgtgcattccgacatggagtttagtatgcgaggccaaagaggcattacttaacggagataatcacaagaaggttcctctatttgaacagatattcatcggcgtaattatcggcctggccgttacaacagcaagcatactctacgttatttacaaaaatgtcgatatccatcaaattttgtttggcgtacagattgtagttgtggctgctactgcaggaagtttgacgtacagatacgtccatgatccacttgccaaaagaaatctcaaggcttcaatggcgctcggcgcaattttgttcttatctggctacatttcgtggctacttgatatacactattgttcgttctgggtgcacgttagaagaagtattttggctttaccacttggtgtactgcttgaaccacacggatggtggcatatattaactggtatggggatttatttctacattgtttctttggaacatttaagggtcattacgctcaacgtcagctgcaattaccagttcatctggagatggaaagtcttccctgaactgatatggaaagggcgcaaaccctcaacaagatattcacttgaactatttggcccatacgtagaagatcaatcaattgaagttaaaaaggagaagtaataattatagcataatatatattcataatgtataggcatatttattttttattttttttatttcatgttctatttaatgacgaatcacgaagaaaatatatctaagaaaagatcttttgaatccttgatttgcgaatagtttaaatgacccagcttattgctctggtgaaaaaaaactttgtgcggtctcaaagccgtcggcggcaaaataacgtgaattgatgaaagtaaataaacaaaacaaaatctctaattgttgtaacacaaatactaagaaatttgttagctaattcgggacatgtaccaaaataatgtattgaatgctattttggcttctgaaaaatcaaactttcaatacgatagtggaacaatattaagaaaccacaaaagaccaataataacatttaataacaacatagagcacacagtatccgaacctaataattttacaggctatgaggaaaaggaagatttggatataatggatatttgtccttattacccaaaagcaagaatgctggcggatgccattcaacatgccaaaacgagcgcaagtgaaaacaaaatggaactatcaatgaaaactatcccatgtctcaagaaggaaaacgtccatgttgagaaagggcacgattggtctcaactcagtacgagcagaatttgtaaaattttagaagacatagcagataaaaaaaataaaactagaaggcaatctgccccattacaaaagacgaagtatttcccaacaaatgagaatcaaaataccgatatagaaaatcagaattggtcccaaatccccaatgaagacatatgtgcacttatagagaagattgctagcagacgcaataaaaatcgcaaacggaaaaatctttcatgttctaaagtccaagaaattcagggaaatattgatttacccaaaaaagacgtacaagagggagatatttcagattcgtctctatttgcagcagtaagaggaaccaaaaaagtttccggatatgattacaattcagaagataagatacctaatgcgatacgtcttccttactgtaagcaaatattacgattattctcacttttacaaatgaagagaaatgacttaatagtcacctctgaaaattgtaatagcggagttttcttcagcaattttaattatcaacttcaagttaaatcgaattgtattgcaaatatttcttctacactcagttttctaccccatcatgaaataaccgtatacacatcctttattctctatccaaacgttgtcgataatatttgggaatgcacacgatacgctattcaacttttgaagtccgaagcagcacagtttacgctactgcgtgatatatatagtggcttcacaattatactttcaaatcatcgatatcatcctaagggttttagcgctgattactgttacagtgcaaatgaattgacattatttctttttgttattcgaacagggcaaaaaaaagtactttatcgatctattcctcacaacacagcagcaattgaaaaagacagttcttttgatacagaaaatagaaagagaaggtccgaggaagaggttgttcttaaatgtaggaagtgttctaataattcattggcattaaaagaaatcagcacctatcgtttggatagcgcagaaggttttgagaagtctcagcctctaaaagatgaagcaaagctcagtgatatgaattatgtacaaggtagtatcagctataacaggactattcttaccggcttatggaaattatttcacagattgtgctgcaaagatcgttataggaaaaccaatctgtcagaaacattgttctatgacgattcaacggaaagatgggttagaatgggagagttaatgcactattgaaagggagatgcttcaataacttttttcatgaaaaactatttaataaatttaatatatatacttcagaatgaaaaacaaatgaatagtttttactgaatatgtaagtggtatgtggaataagaaactcaaatgaagcaatggctatttacagatgttccaaaacttttcgcatttatatacatattgccttagcttggaggtaaacgatatatatcaccgttaactttcattctgtgtatggcaactttagcatcgtcctcgtagcttttcggtaatttatcatttggtttactttcaaacaaagatcccattaaaatcatatcattagttgtagcatcacacaaaaaggcaatatagtctacaacgtcacggtctaacgtctcagtcttcttagtttgctgattgactttaattagtctttgcttcgtatcaaatttgtaaaccaactgtaaatgctctaacggcattccgggaatcatgattggttgcactgagactagtttaggaactgcattaaactttatcaactgccagtccagtgttgcattacctggaagttgacgggacctagcctcgagagcttcctgaacccataatgaaactaaccctttgatgtccgacaaatttttatgagcaaatgacgtgtttacattgatatacgtctctatggctttgtttttccagagtaaaaaagaaggtttaatgcctgattgaaaacgaaacaatgcgacttgaacagagttcaaaccaaacgtgtaaagtcttctgatcaatgcatttgcaacaatgagaggatgagcaaatacatttggaaggttcttgtaagccgaggggataaatatttcggcagcaacacccaggtgccgaggattaaaatcttgctgcttacttttatctttcttctttgtagtttcactttctttattcaaaattaacctcgaagttgaaaataatcgccgcttgttaaatgatatcaacaaggatcttggagggaagaaaaggcatgtagatcttaatacactcatctcataagcttagctgaatggataggcttgctttctgatggaaatttgccttgcttttccaactattccattactcaggttttatttttttattttgtaatatggggagaaggccggcagaatatttacggacaaatgaataaattggattggattgactagtggaacgtgtaaagatcgcgatactccgtaccaatcaccgaaagattgcccgtaaccgaaatgactccattctctgaattttttgtgaaaccaatatctgagactcttccttcatcttatcaacgtattgttcagtcaattaagtaagaagtatatttgagcgcagccttaatcatatatagcaccagttatatgtttgcccctctcttgagttgaaaaacacataatacatagtactgtacttttctctttttcatcgttggcgaaaatataatctttctcaaaaatatatatatatgtatatatatccttagatttgccgttgacaataaggtgggcggcaaatctacgaaatgcgaggcggttaaaagagagtgacaacattttcataaaaatattctgatctcaaactgaagacataaaataaggatatgagctacatagttgacctacaagtgcgaggatcatctctgagggttatcaaatgtatgtttagagaggatgagcaaatttcttctctacattctggttctgactcgaaacaaaacagcaacaaaaagctgggagaatttttgaatctgttaaaagcagtggtcaagaggaagttggaaagtttcccaaaagaccgtttaaagacttcgattataactggccaagaattaatgagagaggggcaaggaagtattgaaattaaggatccaccaacggaggcgcaacaacatttgattagaagcctagcaaaagttttattacaccagttttcaagcataaatggcaaagttaacacagtaaatgaaggacaagataatttgtttctatccttattcgttaaaaaaatttctatagagcaacagtccacatcacacgtctctattaaattgaactttcatgagaaaataaatttgggtcagcacatagattctattttagattcagaggagaccaacgagtcggacacttatcacatgggatctgttgacgagttcattatatatcccttttgctgtctggaagagcaagatgagctgaaaaatggcagcatactgtccacagagttcgacaagattgacttagaactagacgaggatgatggttttgagggagaaactttaaacaattgtatcaattcggtgggaaattttgacattccactaagtaagcaaacactaaacttagtaaatatatcatatcttccaggcacaactttcgagggccaatgggaatcgttgtattttggtaacaatattaaagaaaggttatatagctacgcaactatatctctcaagatagcaagattcaaacaaactggagactccaatcaagaagacattacaacgctaatcacaaataataaattactccttgtccatggtcctccgggaacaggtaaaacaacgttatgcaaagcactttgccaaaaattatctgtgaggcgggaattttcagacggttccgataccattgatactaattataaggggataataatagaattgtcttgtgcacgcatcttttctaaatggtttggagaatcgtcaaaaaatatatcaatagtattcaaagacattgaggagcttttaaaggtcaatgagggacgagggatctttatatgccttttgatagatgaggttgaagcaatagcaagttcaagaacaaatttgtcaagtagaaatgagtcaacagatggaatccgagttgtgaacactttacttacgcaacttgacaggctgaaaaaataccataactttttagcattagccacgtctaatttattagattcattagatgatgcttttgttgatcgagcagatggagttttttatgttggaaatccaacagctgagggcatcctccacattctaaaggtttgcatagaggagatgataacttcaggtataattctttttcacgcaagatcaactggagtcaagttcttcaataaatatcaggacattttgcggaaaattgctatcaaatgctcggtatgtttttttcttttattctacttttacgattctttttctttctttccttcttcataaaaaagcactttcactaactgtctttgtcaaacataaatatgcgatcaatatagaccgttgatatcagtggtagaacaataaggaaattgcccttgatgtgtctgtctgaatacttccggacatttcctgtagacgacgatgagtttgttctggcattagctatgtcagcgcggaagctgagcgcagcgcggaagtgacggaggagctttttcctttttttcgcttctttcttttgtctcatactcatgtagcatactttcgcgaaccctattccaacgttttgttgttgctcgctttcatgcttaaaatttttattatgtattttacgatcaaggtgtatcgtgaaccacacgtttatgaaatccttattttagaatcaaaaagtcctacaatcttgtttgtggagtctatataaagctaaagttaggttctacaaagcaagatacaaatacgaggccatcgagtattcaatgggaaatatgataaagaaggcatctttaatagccctcctaccgctgttcaccgccgcagccgctgcagctactgatgcggagacatctatggaatctgggagttcttcacatttgaagtcttttttaatgtccgtttctatgattgggctttctgaaattggtgacaaaaccttcttgatcgcagccttgatggcaatgcgtcacaaaagagttctggtgttctcagcagcagctacctccctcgctattatgaccatcctttctggtgtggtgggtcattcagccgttgcttttctttctgaacgctatacagcattttttgcaggtattttattcttagtgttcggttacaaattgactatggaaggtttggagatgtctaaggatgcaggtgttgaggaggaaatggctgaagtggaggaagaaattgccattaaagacatgaaccaggatatggatgatgttgaaaaaggaggcgacactgcgtatgataaacagctgaagaacgcttcgattggtaaaaaaatagtgcacaggattcgcgaattagcatcatttatgttttccccagtttgggttcaaattttcctgatggttttcctaggcgagctaggtgaccgttcacaaattagtattattgccatggctactgacagcgactattggtatgttattgcaggtgctgttattggtcatgccatttgctctggattagcagtggtgggtgggaaattattggcaacaagaattagcataagaacaatcactcttgctagctcgttgttattcttcattttcgccttgatgtatatatatcaagcattcacaactcaggattgagatggtttgtaaccgtattcttcttggattctctcttttttctcttcatatttaagtgtgaatcttgaaaagaatatttatagacatacgtaactagtgtacggctgatatttatttgatgtagcttttttttttgctaagttcatcgcttttctttcccagccaacccaatgaagtcttgcgcacgcaattggttgtaattatccgatcagccgctatcatcattgtcacggtcgggttcctgtaatacccttttccttattattcccttaattttttcattcgttttcttctcgagcacttccataataggcgctaatttggctttgagatcgctggtttcgcaaaccttatcgatgtaacgctgatgttcgtttttttgggggataatatatggctgaccactctctttttgtttcgtcttctgaatagtttcttgtacaaaactattcgttgcgttagagctctgtcctgtttgaatcaccgtgtcatatacaggttcatttgaaatatttaaaccaacaaaatcattggcttcttctttgcctgttttgcccagctggttgatacgggcacgtaactgatttaattcttggtccctttctagtgataaatctcgcagagagggcatactggttgtaaaaagtagtcgcaacaagtaagtcgtaaaaaagtagatgtaatggaaggctttgaaggaacggctagccagcttttctgtatcattcctagcctaattgacagcatcttgaccttctagtatggaaactttcaatttcagaaagcggtgttccccgctgcgacgatttaatccgtacatttacacatctgtacatttttcatattcgcaaaacaaaggttacttgaaaaaatcataaagttggcggcttcaggtggacgcgcttcactcatgtagcttaacattcaatcccattaagcattatgcataaatttcatgaagtttacttaataaaattgttcatttgcatagacaagaaagaaagcaacaagacaactaagactaagcaacaatgccaagtacgtattagactatatcgaagaggagggaaattcttcactctgactcgttgattttgaaagaggttcgggtcctcataaatatttgagaatatgaaattccataatagtataccttcattgagtagcacgacaacagcctgaattactatccatattatgaatatctttatttacactgaactcccgacacttcagttaaacagggatacattagagatcaaggtgatctaatagggaacatctctctcgtaacaatgggacagtattttattttccaaggcggatacctaattatgcgtttttaatcatatctctacaatatttatgagcacttacttgggcccttgcagacttttgttccgggaaaacttttgactaacaagaatccaattttacttttttttttttaggagctccaagaacttactctaagacttactctacaccaaagagaccttacgaatcttctcgtttggacgcagaattgaagttggccggtgaattcggtttgaagaacaagagagaaatttacagaatttctttccaattgtctaaaattcgtcgtgctgccagagacttgttaactagagacgaaaaggacccaaagagattgttcgaaggtaatgccttgatcagaagattggttagagttggtgtcttgtccgaagacaagaagaagttggattatgttttggctttgaaggttgaagatttcttggaaagaagattgcaaactcaagtctacaagttgggtttggccaagtctgtccaccacgccagagttttaatcactcaaagacacattgctgttggtaagcaaatcgtcaacatcccatctttcatggtcagattggactctgaaaagcacattgacttcgctccaacttctccattcggtggtgctagaccaggtagagttgctagaagaaacgctgctagaaaggctgaagcttccggtgaagctgctgaagaagccgaagacgaagaataaataattcgctgatttcataactgtataataaattttataacttttcaaatcacggatcatttttcattttactttgtcatttttatttcatttgaaaatgggtagaggtacataactggcgcttttcttgcaagatgacatggcattggatgacacaagtattactcaatacccaacgtaaatagctagaagattttgatcggatttaaattcccaactgcaactcagtagcgtttaggattttacaccttggcttggagaaatccttattgtcagaaattgaagccgttaatatttaaaggctaattctccatgccatcttgcattcactttggtatatatctcttgacctcaatatatctcgataatataaatcgcaatattatacttgttagtctgacagttttacacctgtacatcttcaccatcaccacacccttttttactggaggcaaggatgagtttgaatatcgcctttttcccagccgctagaacatgctcagaaccgaggaaaagcaccgctgccaaacctcctttgatgtgttggcccaccgctactagtggccgtgctggaagcccaggcagcggtgggggccacaatacgagagctggaaaggtaaacggtctctgcgcctctgtgaaattttatcaccaatggagtgtcatgtctggtaaagataatatagaaagtagtgtgcaatttcaggcattaccgattgaactttggaataagagaaccaagacaaaaataactagcaacaatgggtaaatcgtatgtcatttaatcctatgaatctacagcacgaacgaatcatggtatctcaaaccgaacatatcgtcacagaaataaaaagatttaaagacgtgtctagtgtgaataaagcaaacatatcattagagcaaaatattgggcagataagatgatgctacactgattctgagaaaattacgtgacatgataggcttttaacgggctgtaagtcattagtttacagtcgttgctttgaaaattagttcaacattagaagtgtagtaattacaagccctttttccaaacattcggttatgtgctgggacgcatctcagaaactcgcaaaacaatagaatactaacatgatttcttataaatcttaattttgatttatttccttataatacagacacggttacagatctcgtactcgttacatgttccaacgtgacttcagaaagcatggtgccgtccatctttctacttacttgaaggtctacaaggttggtgacattgtcgacatcaaagccaatggttctatccaaaagggtatgccacacaagttttaccaaggtaagaccggtgttgtctacaacgttactaagtcttctgttggtgttatcatcaacaagatggtcggtaacagatatctagaaaaaagattaaacttaagagttgaacacatcaagcactccaagtgtagacaagaatttttggaaagagttaaggccaatgctgctaagcgtgctgaagctaaggctcaaggtgttgctgttcaattgaagagacaaccagctcaaccaagagaatcccgtatcgtttctactgaaggtaacgttcctcaaactttggccccagttccatacgaaactttcatctaatttacccgatgctggttttgtatcgaaaaagattttcaggttttaggttttattttttgtctatttttaaatatataatataataaaaaataaattgtgtctaatatccataatttgtacatttagattatttcttttggttctttattctgacctatatagactactcaacacagtcacttcatgtcatccagatattacttgcgttgagcatctcttttgaatcctcgcttcgggctctctcttagtgaaaaattaaccttacgccaaaatccaagaagtaaaattaaaaagaataatggtaaaagtctaacttcacatagagaattcaactttgtataaaggggtagccttgttctctatagaaactgttctttgaagtactgctaactgaggtaaaaaaatcggacgattttgtctttacgtggtcctatatttattgtgtcaaagtcacctacttacttacatagttgaccattctcatatcccataatttttcaaggagataaagatgcctaaaaaatccattgaagaatgggaagaggatgccattgaatcagttccatatttagcaagtgatgaaaagggctctaattataaggaagctacacaaattccactaaatttgaagcaatctgaaattgaaaatcatccaacagtaaaaccatgggttcattttgttgctgggggtattggaggaatggcgggtgcagttgttacgtgtccctttgatttggtgaagacccgattacaaagtgatatatttttgaaagcatacaaatcacaagctgttaatatcagtaaaggatctactcgtccaaagagtattaattatgtcattcaagcaggaacccatttcaaggaaacactgggaatcataggcaatgtgtacaaacaagagggttttagaagcttgtttaagggtttgggccccaatttagtcggggttattccagcaagaagtattaatttttttacctatggaactactaaagatatgtatgctaaagcgttcaataatggccaagaaacacctatgattcatctgatggctgctgcaaccgcaggttgggcaacggcgacggcaaccaatcctatttggttgattaaaacaagagtacagcttgataaagctgggaaaacatcggtccgacagtacaagaactcttgggattgcttaaaaagtgttataagaaatgagggtttcactggcttgtacaaagggttgagtgcctcttatttgggttctgttgaaggtatacttcaatggctattatatgaacaaatgaagaggttaataaaggaaaggtctattgagaaatttggatatcaagccgaaggtacaaaaagcacatcagagaaagtcaaggagtggtgtcaaagatcaggaagcgctggtcttgcaaaatttgtggctagtatagcaacatatccgcacgaagttgtcaggacgagattgagacaaacgcccaaggaaaatggtaaacgaaagtatacaggtttagtacaaagtttcaaagttataattaaagaagagggactcttttcaatgtatagtgggttgaccccgcatttgatgagaacagttccgaacagtataattatgtttggtacatgggaaattgttataaggctactatcgtagccttgaaatctaaaaaactctaaattcactttagggccaagacatactctaacaaaaaagtatgaaaaaagtgcattttgtaaggatataaagcctgtcaaagtttatagaaagctaacctactaaggtttggaccccttcgtttcttctcctttactttgcattatttatcgtaacatatcaatgatccttatttacttcattcagtaaattggtccttttatacttgtaaatatttttaccaggtcactagtaacaataaaatgttttaaaatatcagtagcgtgaagtaaaattcaattactagatgatgttgaagtagatcccgtaataatgggcttttcccctgtgaaggtgaactttagaacatcatccacattgaaaggtttcgaaggtttgctatctcgtactagaagtgaagcgtgttcttcgcttagggattcttcatttttgaaatcgtgctttccatattcgtttctaaacgtagtgcgcgcccaattcgttatttctctgtcctgttgcagcagcttttctatttcttcatcctttagcaaggctgtagttactccagatgtttccctaacatatttcatccattcgtccacttcaggaatattcttcttcctcaaaagggtagtgaccaaactttcatgagaggtggttgggaatttaggcaaagggtaaaccactgtagagtctaaagtttcttggaaatgttgtagagtggaggttacagaaacgagctgggataatgtgacattcagttgtgattggagtgtataccattgtggcagttcggctttggacatttcgtctctgattctcctcaatgaatgagttaattgagccaaacgcatgcgcacggcatctaaagcctggccaggtacaccattgaaatcaaaactaacatcttcttggagggagccttgattgccctctggtaccagtgatgcagtagattgtgacatattccacgttgctttatgtttttcttttgttcttcttgctcggggttctcttatatcgatgaaatatttcaatattaaaatccttaactttgacgaaaaggcaatttttgtatattgagtttccttacttttttgaacagaacgtacttttagacactttgcaaaggccttcagcaaatttttttgattattttcaaatatcaaggaaatatattaccttcaaagtcatccaatccttttagttctcgcattccatcattttatactatatacgtttgagcttaatggatcaaaagaaggacccaagtaataacttaacagaaagaagggtttccaaggtccaacgcccaaataagaaaaaggtacgaaatcaagttgaatcactttctagaaacctagagagaaataaagagggacagcttctgcagactgtatcaaaaggtcatttagaagctgattctggacactcactgggtcgtgaaaaagagaacggtgaactcggtataagaagtatattttacgataaagactggaatccaagaggcactgcaccatcacattacagaaatataccttataatcctgccactttcaaaaggcgaactgaagttcaagccagactgggaaacctcgagaatatcaaaataccaaagtgaaagttcaaaggtaataaatgagcaaccactttcttcgaaatacaatattgaaatcagcatgaagtctgagcgtagtgtttattgtagcaagtcttgagcatattttataaactctatttatgtttgtatattcgtctatcaaatggttgaatatgtaatagggacaggagccattagcatgcctggcttcaaggaacgtttaggtcacgaatgtccaacaaggtttcctgcaggtttccatatgtgaactgaattatcatttgccacactgcacattaaccaagggtcatgagcgtcccacgaaatgtcgttcacaccgagcatatgaccaccatgggtaaatatagtttcttcgcaggaggtatcccatagcttgactaacccatcttcttggccagccgttgccaatacagtatcgaaatttggactccattctaaagttgaaacggaagtaccgtgctccatggtagcgattgggcttttgttcatgtttctaatatcccataaatttagcctcccatttgaatctgcagatgctagaattaaagagttcttatagttaaatctacaggagtttactccaccatcgtgtttttcacggttactctggagcttctctttcttagtcctcagatctaatagggagaccgcatttccttcagtacaagcagcaaagagggaatcgtgtgttggcatccaagttacatcattcaccgctgttccgtcgctgtttattgacactaagggtaaatctattatagggttctcatgcgaatattgtttaatgtcccaaacttgaacttggccgttggagtgagaagaaagtaaaagggcctcctgctgcaagttccaggctaaagaagtcgcctcatttatatctgccgaagaagtatccattgcctccacgtcttgaataacaccatgtgaaccaaacagctttgtctcaaagggatgtgaaattttggactgtcttattctagtagagccgtgttttgttctatcgaatatgtagattgcaccatctgaagaggcgccggctataatatctggattttgaggcaaatatcttgccctattgcattccccgtttgggaagaaaatactgatgtcatttactaagtgtttggagggaaaccttgtcgagttctccggtttgaattccatttcgtccatgtcgaaattatttaaagatgaccattttatatgacccaacgtggatattttgctaatatatatggtctcatcttcaggtttttgggaagatgtaaatgaggataacaagatgcgatgctcatccgaagtggtatctaaatcaggaaagaactggcacgttaaggacggccactttgttgaattcgtgtttaggtaatcataaagtagtttagtgtttttcttccagtgcgagtatctttcttgcaaatcgatgggtatactggaggcttcatgagttatgtccttcgcgcactgattcatctttgaaactaaatttgtatattgtttgtcagaaataggacctgatatcctccttttaaacagttgatgagaacctttttcgcaagttcaaggtgctctaatttttaaaatttttacttttcgcgacacaataaagtcttcacgacgctaaactattagtgcacataatgtagttacttggacgctgttcaataatgtataaaatttatttcctttgcattacgtacattatataaccaaatcttaaaaatatagaaatatgatatgtgtataataatataagcaaaatttacgtatctttgcttataatatagctttaatgttctttaggtatatatttaagagcgatttgttcacatccattccttgaattgattgattaaaccgttggtagaagcatcgtgggtagaaatggtggaggagttgtccaattccttgccgatgactttagccaagactttacccaattcaacaccccattggtcgaaagagttgatattccaaatggcaccttcagtgaaagtaacatgttcgtagtaggcaatcaaagcacccaaagtagctggagtaatcttttgagccaagatagaggtagttggtctgttacctgagaagaccttgtgtgggaccaaaccaccagtggcaccttcagccttaacttgttcttcatccttaccaaccattaaagcttcagcttgagcaaagaagtttgaagccaacatcttttgatgtaatttgttctcaattgggttatgagattgagcagctaagatgaaatcagatggaatcaacttggtaccttggtgaaccaattggaagaaagagtgttgagcgttggtagctggttcaccaaacaagatagaaccagtagagtagtcagtaaacacgttacctctggtaacagacttaccgttagattccattgacaattgttgcaagtaggctgggaatctgtgcaagtattggtcgaatggagcaaccaaatgggtttgagcaccaaagaagttgttgtaccagacagacaacaaaccacccaacaatggaatgttgtcttccaatggggtttgggtgaagtggttgtcgacggcttcagcacccttcaagaaagcctcaaagttgtcatagccaatgtacaaggcaacagacaaaccaatagccgaccagacagagtaacgaccaccgacccaactttcgaaaccaaacatgtttttggtgtcaataccgaacttggcaacttcggtttcgttagtggacaaagcagcgaaatgcttagcaatgtgagatggatcattacctgtcttcgacaagaaccagttcttggcagtgttagcgttagtgatagtttcagcggtagtgaaagtcttggaagcaatcaaaaacaaagtagtttctgggtcaacaaccttcaaggtttcagcaatgtgagtaccgtcaatgttggaaacgaagtggacatccaagacaccagcgtagtgcttcaaagcctcagtgaccatgactggacccaaatcggaaccaccaataccgatgttaacaacatcggtgatcttcttaccggtataacccttccattcaccagaacgaacttgttcagagaactccttcatgtgcttcaagacagagtcgacttctggagcaacgttgacaccatcaacgtacattggcttgttagctctgtttctcaatgcgacgtggtagacagcacgatcttcagtggagttgatgtgttcacctttgaacatagcatctctcaaaccggtgacgttagcctccttggccagttcaatcaatgcagcaatgatttcatcgttgaccaagttctttgagtagtcgaacaagattttggaaccatcatagttggtgaaagtcttgttcaatttttcaaaacgcttggcatctttttggaattcttgcttgacagacaaagtcttaccttgagattcataaattttttgcaacttagaccaggctggcaattcagtggccagtttgaagttagtgaatgagttattggacatttttaggctggtatcttgattctaaatcgattttgcaagactagaggaatatgtattaaaattcactgaatgcaagtaaaatattaagtaaaagaaagcattgattatgaagaaaggacctttttaagatatgagaacaatgagaaaaggaaaaatgggacgaaacaaatagggaaaattccgtctgtaaaaccaattgtagtaacaaaaaacgctcatttcaatagcaaaaaaatagaataccgtcaatggatatatatagacacgggacattataacaacgtgcagatggtgatgattgcaaacccaaaaaattaccagcttcctgtaattccaggttgagcgcgtggcttcctataatccaatacacccacacccacccagatcgtgatttttgttaccatcccggttcttgcctcattgacatatttttctgacggtgacagaacgtggccttgtacactcttttttaatgttacgctggcacaacatagttcaacgaaaaacgaattaagttcttacttccgtgttttaatcagaaaacgatattccaatgagagatataagcgtaaggtagcatgtccgatggcaaaattctctttgcttccgcagcggggccaaagtcttactcgcctctaaccccacgtaggacaagtgctgagaataaaatagtcttggcgtagtatgccttcttcagtaatattttttcttttgaaagtactacccacatccgaacattgccacttacatagcgatgcaaatagccgccaggaaatgccgcatgttatccactaagaatagtcaacattgcatagcatccaaatacgtgaaagcggaccgatcttgagcgaaatgtttagtaccgttgatgtgtagaagtagtgccctgaaatacatagcggtgtattatttagcattaacatacaaaaaaaaaataacggaggcaccaatggaagtggtgtcgctacattagtttttaactcagtcagaaaactgaatttagttgatatgggaccgctccaaggtaggagaatactagatcaagtaaagcaaccgcactagtgcctttttcaaacaaggtggtttgatgaggaggctttctacaatcctagaaatataagacatctgtcagattagccgccgttcatatggtttcaaaaggttgcgaatggagacaaacgttcctcgtcccaaattagccagacggaacaggacaataaaggtgataatgtaatccatgacttcctctattttagacgggacttttagcatcctctaaatattttcaacccatacatgtcatcagcatcggtgaacatctttaatagtatcgacaacttggctcacgtacttctcaccgtcaagtgcgatttccgggtcatgcaatacctcgtctggttcttgatctttattcgtggcagaattatgctgatccttatgaggagggctcctcagcttggcatactttagtcgctgatttctttccctcattaatcgcagtagttgagcgtgcgacttgcgcatttgcgtgagattgctctcaaaatctcgtgggaacccgtcgttgacgataggttctttcgccatcttcttcacatcatccagtgtatcgatttcagaccatgatacgtcttgcgtctccgtaggtgccaggtttgagtgcattgttatacggctaccatttacgcttctttcgtatgcagtattacccctactaatgctggtcgttaaggggtttagtgctggaggcgtggttaggtttttggtcggaagtgcgttggaactgcccattatagaggcagtggaatctgaagatccctttcttttatctttgtcgctctttgcctttaattgaaccagctgagggtttccttcctggctactagatttccttctgttggtggaatccgcgtcgcttactttcacctggactggtggggtttgcttcactcccattatttgtcttcgttcgtgccagcaacatacatttcatcttatttctctggaaggtttttacaacaaccagttacatttttcatttttctgttcttcgcctttcttgttttggccccgatgactgagcgaaaaaaaaaaggctaaagaagacgctatgataaccgccgagcaggtcaagtacgatgtcgaaaaagcatctaatagttacatatcggattaggttatacttattacatatcacttccatgctgttatttttttcagtgtgaattatggcctgaaagcacctcctgcaagggctaaattgcttctgctgaacttgaccttaaaaacaggcgtctttttggtgtagaacgacgctactaaatcgcttgtaggtattactgttcttctgcgaccatattcttttatatcttggtttatagatgcagtaacgtcacccaagtatccaatgaatggctcatctggttctgcgcttggctcagtagtggcctttttcaaatcccatacacggactgtatgatcggcacctccactaataagtacgtttccctctttgctatatgataaggaataaatggcattcttaccatggccacgcatttgtttcaaccttttgccggtaccaatatcccatacattaataataccatcttcgctaccagtggacaaccacctaccatctggacaaacagcaatagaaatgacgggcgcagtatgtccaagaaataacctaaccgagtcgcctgtagaaacgtcccacattcgacacgtcttatcgctggatcccgtaaacacatagcaaccgttcggatgaaatgacacacaatcaacatcatttaaatgtcctgcaaatattcttaatggatatatgtgatcgcatgaccataaccttgcggtttggtcgtgcgatgcagtggcgaaataatggcctagcggggagaaactaacatcccacacagggtgattatggcccttatagcttactagcgcggtgtgagtatccatggaccatagcctgacggttttatcttcagaaccagaaagtaaatacttattatccggactgaaacttgttgaatatactgtaccactgtgccccaccaaagttttacacgttgggtcttcatccttgtcgttgttatttaacgcgatgttaggattattaagtgatgagccgtcgagtgaccagatcttgatataactgtcttgaaagccagcagccgctatcctacaatcatcactgaaatctaaacatgacatgtctttatttgtgttttggaatgtatacatgcacacgcttggtaaggccaactgtaaattatctagtttgatggcatcacgagattccttgaccttctgaatctccaacttcaaatctagtgccgtctttggtggtaaaggtaaaatatcacgtgctggcgaagataaattgctgtcttttttttcaccatccaccttcaattcgctctcttttttttcctcatctttggcgattttatctttaattttgtctttatcatcgtcgccagtattatccttaaatttttcgttattcatagctttatattcttgcaataaggttctattgttggctccactgtaattgtcacctgcagtttgttgatttagttgtttctcttgatcatccttaattttcaattcagtttcaatctccttaacaaactcctcgtcttttgggaaaggtcccagcttgacaggaacagaattcatttctaaattttgtttaccatttccgttttcactatcactgagaacttttattccatcagccaatttttcccttgcggttactgattctacaatatttggatctaggtgctgatttattacactaattattaatgaacctccaatactctcattttcattcaaaaaatataagagaagatttaaagtggttttagacatagtaattctgtacttgtgagattggaaagcacttgcgacctcattttccttgatgtgatctatagaattgacactgaaaagtctattaatttctgagccatggaagtccttaaaatcgggagaaaatctatcaaagaaacgacgggcgtaaacaggatttttggccaccaaatttaaaaataaataaatgaatattgggtacatgatgtagcttagttccggcttgtaaatttccagcgacgaatctacccagtttttcaacattgaatatgcacgtatataattttcaggtgcgttgagcccttctagtcgcccgctagatactataccaccttctgcatctctcttggatgacaaattagttggattgcttatgggtttagctgtcttcccggggttcggaggaattgatgattgttcaggaaatttacctgttttagtatttgctggtgattgtttgttttgaggtgttagtgtacgtccactctcggctctcagcatggcctctgtacggtggtatccctttttattcaggtactctaggacaattctattcaagtctgacgccgaaaacggaccattggacctcccctgctgttgagactggccttgactctgttgctgtggctgctggccggaattggcgccagcagcattattagttcgttgattctttactggttgtggctgatgcgtgccattttgattctgattcgtactttgcttctgtgacattcttatttttcaagtatctcaacttgaacccggagtttctcgtatcttttctccttctcttttcctacccttatgcctgctttattgctctttctgccactttgtagacttcatttgaaatcttgaaacttttttgcttttgaacaattcatctgaacccgtaaaagatgatatttacagctacttttacccggctaaggggagaattccattcaacggaacgagctctataagacgttctctaactgcatgtagtgaaatattttgaaccatttgatatgcagatactttcacggtgttgcacggctgtataatatacaataggccgttacagcagaacacaatttttagtttagacccaacaaggtgaaccatacgaactgatatgaggtttctttcaaaaaggatactgaaacctgtactttcagtgatcattctaatatcgattgccgtaaccgttgttctttactttttaacggcgaatgagaactatttgcaagcagtcaaggatagtgccaagtcccagtatgcttctctccgggagagctacaaaagtattacaggtaaaactgaaagcgctgatgaacttcctgatcatgatgctgaggtgttagatagcataatggacaggctacacgagcccctttatgaaaaggacacttttgacccgaatgaagtccttgctgaaaataaacagttgtacgaggagtttttacttcaagaaatttctgagccaaaggtggacaatttggtacgtagcggggatccgttagccggcaaggcaaaaggaactattttgagtttggtgagaaattctgatttagaggatataatttcttctattcaacagctagaagaggagtacaataagaattttggatatccctataccttccttaacgatgaggaatttactgacgaattcaaagatggaataaaaagtattcttcctaaggaccgtgtagtagaatttggcactattggtccagataactggaatatgcctgatagcatagatagggagagatacgaccaagaaatggacaaaatgagtaaagagaacattcagtatgcagaggtggaatcctatcataacatgtgtcgtttctattctaaagaattttaccatcatcctctgctatctaaatataaatatgtgtggagattagagccaaacgtgaatttctattgcaaaattaactatgacgttttccaatttatgaacaagaatgacaagatttatgggtttgttttgaacctctatgatagtccgcaaaccatcgaaacgctatggacttcaactatggattttgtcgaggaacacccaaactatttgaacgtcaacggagccttcgcatggctaaaagataactctcaaaatccaaaaaattatgattatactcaagggtattcaacttgtcatttctggaccaattttgaaatagtcgatttagactttttgaggtcagaaccttatgaaaaatatatgcaatatcttgaagaaaagggaggattctactatgaaaggtggggtgatgcccctgtaagaagtttggcacttgctttatttgcggataagtcaagcatccattggttcagggatataggttatcaccatactccgtacacgaactgtccaacttgtccagcagattcagataggtgtaatggaaattgtgtaccaggcaaattcactccttggagtgatctagacaaccaaaattgccaggcaacctggataagacactctatgtctgaggaagagttagaaatgtattgaagacattagctttgagaatttgtgccgctgctttcgagaacggcatcacatctggggttttatgatttaatttaggacgcacatagatagatatatattatggaattaagaaaagtttataatgtagcaacctaaaaatgttacaggtgaacattcatggaaaatgaaatgtttctcagccagtagatagtattgttgaaggtattattggtttgagaaagctactcctcaaaaatgtcacttgataatatggaattataatgtcgttatattttcaatcatttcaatacaatatggtaaaccgaaatccaaaaactttacaatatctcttatctattgttattcgacattcttcccgggccttaacggcttcttaactaatattaccctaaacggacaaatggcgaagggccccattcatttacgaacaggaaaaaaagaaagtgacaatacagccataatttgatgtaccatcttaatcagcatatgttttcactaatatactaaacccatatggatgcacgttgaaagcactgtgtgaaaagaaattgtcaagaaagccatataaatgctgaaaaacttcaaactctcaaaaagagatagtaatgggtcgaagggcagaattacatccgcagatatttccacaccttctcatgataatgggagtgttataaagcatattaagacagtaccagtgaggtacctttcttcatcttccaccccagtgaaaagccaacgggactcttcaccaaaaaacagacataattctaaagatattacttctccagagaaagttataaaagccaaatacagttatcaggcacaaacttcaaaggaactatctttcatggaaggtgaatttttttatgtatctggagatgagaaggattggtataaagcttcaaatccttctactggaaaagagggtgttgtccccaaaacctattttgaagtgtttgatagaactaaaccttcctctgtgaatggatccaatagttcaagtcggaaggttacaaatgattcattaaacatgggatcgttatacgccattgttttatatgactttaaggcagaaaaagctgatgagttgacaacttatgtgggagagaatttgtttatttgcgcccaccataactgtgaatggttcattgctaagccaattggtcgacttggagggcccggccttgttcctgttgggtttgttagcatcatagatattgccacggggtacgcaacaggtaacgacgtaatagaagacatcaagtcagttaacctaccaactgttcaagaatggaaaagcaacattgcaagatacaaagctagtaatattagccttggttctgtggagcagcagcagcagcaatccattacaaaacctcagaacaaaagcgcaaagctggttgacggtgaattattagtgaaagcatccgttgaatcctttgggttagaagatgagaagtattggtttttggtttgctgtgaattatctaacggtaagacgaggcaactgaaaagatactatcaagatttctacgatctgcaggttcaacttttggatgcgttcccagcagaggccggtaagttgagggatgcaggtggacaatggtccaaacgtataatgccctatatccctggacccgttccatacgttaccaatagcataacaaaaaaaagaaaggaggacttgaatatatatgtggcagacctagtgaatcttcccgattatatatctcgctcagaaatggtgcattccttattcgttgttttgaataatggtttcgacagagaatttgaaagagacgaaaatcaaaacaatattaaaacattacaagaaaacgatacagcaacctttgcaacagcatctcaaacttctaattttgcctcaactaaccaagacaacactttaactggcgaagacttgaagttaaacaagaaactctcagatttatctttatcgggctccaagcaggctccagcccaatcaacttctggattgaaaactactaaaattaaattttattacaaagacgatatttttgctttaatgctgaagggtgacacaacctataaagaacttcgtagtaaaatcgctccaaggattgatacagataattttaaattacaaaccaaattatttgatggtagcggggaggaaattaagactgattcacaagtcagtaacataatccaagccaaactgaaaatttccgttcacgatatttgaatctagtgttagaagacgaagcatttttcttctttacttggcagatgcacataggttgaacattttaatcaactttatgatgatttgcgagagtaataagattctcccgaacagtaataatattaaggtatccaattcttccgaaacagcgtgatttgtaataaaaataaataaggacatatatgtatatagaaagttgcttaaactttttagaccacttggaaatattttttatttatatttttcttcaaatgtaaagttgggtacctaagcttaaattcacctgaaaatgaattatatgaaagattttacaccacatgtaaaaaaaaacgtacaaaaagccaaatatttccactcaatcataatgcatgaattataggtattttaagttatattgctgacgtaaaattcagaagagactacaagaaaaattctgaacatatttattcttaaatatgcttttgtgcttccatatgtgtcaaaggataatgtggctccctttcgatttaatgaagtggcgtagatttcattgtggcgctgttcttgttggaacactgagcttacgtaaccgcagcccaaagatactttctctttattttattagcgataggacaggctaaaatgataatcactattaatcaagcagaaagtaattgaaattattgtaaatcgaaatacctgtaatgtagcaaaacttttcgtggttgttacagcaactttttatacttaatatagcaagagtatccgtttttataaggcctacacaacggaatcctcttgatttccttttttctttgtaatttaccgacgcacgaatacgcgcgctgtcctttttcaaccatccatataaaccataaatggcccaagatagatgtgagtccctaaattgaaatcagttgaaaaacagaaggtataacaaaaccagatagacacctaataaagaacaaaatattcctatagttttgctgaacatagtttttattgaaagtttagaagaattacagcagagatttcgtcaccaacagaagaaaagctaaagcccaagcaatatggatgctgtaatactgaatctcttaggcgacattcctttggtcacaagattatggacaattggctgtcttgtactatcaggtctcacaagtctccggattgtggatccagggaaaggtagtgtacagttatgatttagtattcaaaaagggacaatatggaagactactttattcgatattcgattacggcgcatttaattggatatccatgataaacatctttgtcagcgctaatcacttatcaactttggaaaactcattcaatctgagaagaaaattctgttggataatatttttactgttggtgatactggtaaagatgaccagcattgaacaacctgcagcatcactcggtgtgttattgcatgagaatctcgtgtactacgaactgaaaaagaacggaaaccaaatgaacgtacgattcttcggtgccattgatgtttcaccatctatattcccaatctacatgaatgcagtaatgtattttgtatataagcgtagctggttagaaattgccatgaatttcatgccaggtcacgtaatttactacatggatgatataatagggaagatttatggcatcgatttgtgtaaatctccgtacgactggttccgcaacactgaaacaccctaaaggaaaggccgtttttatttaccaaaaaccaataacaaaagtgaacgcttgataaacaaacatacttagcataaataactacatataaaataggccaaggataaatgaaacgttgactagaatgaatgaaagatgtgaaaacagtacagttaaaactgcaatcccacaaactaaaaataatatgaagaacctgtctcaaatgtataaatgcagaataaataagtagccgaaaaagtctcggtaattttctccctaatgataacccatattttcgaaagactctaaaacctggtgtatgatcgttgagaacaaaattcgtccttgtagtagtgtgtgtctttagaagccattcgggccggtagaaggaaaggtgttgttagtcccagagtgatgtaagcaacataaaacaacgtcgtcagctttttactgggagcacttgccttgtatgatttagaaacttgtgaaaatgatttcatggccagcattgttagtcctcgatcttttgtgatatttcctatatattacaaaaaaattcttggttttcgccttgtcacagggaataaatgtggaatataaaagagaggagaggagaggaaagaagaaaaaaaacttggtgtccgtttgcagatggcctattatataccctgcttatataactctgagaattaggaatattttgctgttgctatggtaattaacatatttccaacaataatgaccttctcgagctattgtcttccttgcagtggcgaagaaaccaccggagagttgcaacgaactgcctttcttaggaagtgcgcgggctctctattatgataggccgatacggtacaaaagcttaaagttgcctttgtattaccttttttaatcgcagcaaacaatgcgaagcacaggtgttcactttccttagcttccccttttccgtgcttttgtttatacttcgtacaaaaatgaggggaaggtaccaggcaggatacctcactgattacgacgacaaggaaaagagtaaaaataatttactgtaaaacttccaaatttgtctgagagcaacagaatagaagcacaaagaaatgtaccctacgagagacagagagggtaaaagagtaagtaaattctaaagtggtgtgaatgtcataacttaaactattacccacgggatacctgctaggtcaacgtagccgctactcgaatataataagcgcttcttgtatattttctcaataacaggcgaggccccttctacccttgaatgctacttattactcactcataatacattgtataagccttcgtgtttttcacggcctcgaaaaaatttttcttaactaatttacccagaaaggaaatttccttataaggaaaataaatgcaattcattaagtcggtttgcttcttttttcacgaaagtgagatacaagcaaaggaccagagcgagatgtactacagtagcaggctacatacacgtctttaccaataacttacatttagaaaggcaatataatcactacctagattagcttgaatcttgcaggaagaactcaatacagatagaccagattatgagtgcggcacttccatcaattcagcttcctgtcgactataataatctttttaatgaaatcaccgattttttggtgactttcaagcaggatacgttgtcttctgatgcaacacgaaatgagaacgaagatgaaaatttggatgctgagaatatcgaacaacatctattggaaaaggggcccaagtacatggcgatgctacagaaagtggctaatagggaactgaattccgtgattattgatttagatgacattctacagtatcaaaacgaaaagtttctccagggcacacaggcagacgaccttgtgtctgccattcaacaaaacgctaatcacttcactgaattattttgccgtgccattgacaacaacatgccgctaccaacaaaagaaattgactacaaggacgacgttcttgatgttattttaaaccaaaggagactgaggaatgagagaatgctctcggacaggaccaatgagatccgaagcgaaaacctcatggataccacgatggatccaccctcttccatgaatgatgcgttaagagaagttgtcgaggatgaaactgagttatttcctcctaatttaactagacgctatttcctttattttaagcctctatcgcaaaattgtgctcgtcgttacaggaagaaagcaattagttctaaaccattatctgttaggcagattaaaggtgacttcctaggccaattgattaccgtcagaggtattatcaccagagtttctgatgtcaaaccagctgtggaagttatcgcatatacctgcgatcaatgtgggtacgaagttttccaagaggtcaactctcgtacttttactccgttgtcagaatgtacttccgaagaatgttcccaaaatcaaacaaagggtcaattgtttatgagtacacgagcttccaaatttagtgcctttcaggaatgtaaaattcaggagttatcacaacaagtgccagtgggtcatattcctaggtcgctaaatatccacgttaacgggacgctggtaagatctttatcgcctggtgatatcgtcgatgtaactggtatattcttgccagcgccctacaccggtttcaaagctttgaaagctggcttactgacagaaacttatttagaggcacagtttgtccgtcaacacaagaagaaatttgcgtctttcagtctgacttctgatgtagaagagagagttatggaattaatcacctctggtgatgtttataataggctggcaaaatctattgcaccggaaatctacggtaacttggacgtaaagaaagcgttgctgctattacttgtcggaggtgttgataaaagggtaggtgacggtatgaaaatcagaggtgatatcaatgtttgtctgatgggtgatcccggtgttgccaaatctcaactgctgaaggccatttgcaaaatatcacctcgaggagtgtataccactggtaagggttcctcaggcgttggtctgaccgctgccgtcatgaaagatcctgtcacggatgaaatgattctagaaggtggtgccttagtactcgctgataacggtatttgttgtatcgatgaatttgataagatggatgaaagtgacagaacggcaatccatgaagttatggaacaacaaacaatttcgatatccaaggcggttatcaatacaaatccgggcgccagaacctcaatcttagcggcagcaaatccgttgtatggtagaattaatcctagattatcacctctggacaatataaatctaccagctgctttactatccagatttgatattctcttcttaatgttagatataccaagtagagatgacgacgaaaaattagccgagcacgttacatatgtgcatatgcataataaacaaccggatttggacttcactccagtagaaccctctaaaatgagagagtacattgcctatgctaagacaaagaggccagtgatgagtgaagctgtaaacgattatgtggtgcaagcttacatcagattaagacaagactccaagagagaaatggattccaaattttcctttggtcaagccactccgagaactttactaggtattataagattatctcaagcgctagcaaagttaaggttggctgatatggtggatatagatgatgtggaggaagccttgaggttggtccgagtctccaaggaatcattgtatcaagaaaccaacaaatctaaagaagatgaaagccccacaacgaaaatctttacgatcatcaagaaaatgttacaagaaactggtaaaaacacgctatcatatgaaaatattgtgaaaactgtaagactaagagggtttaccatgctacaattaagcaactgtatccaagaatattcttacttaaacgtctggcatttaattaatgagggtaacactttgaaattcgtggatgacggtaccatggacacagaccaggaagactcactagtgagcacgcctaaactcgcaccacaaacgaccgcttccgctaatgtgagcgcccaagattctgatatcgatctacaagacgcttgaaagttctaaaaaaaaaagcaacagggccttcattctttattctttttccccctttttttcatttccatatagctgcacattcaaatttaccttctgtaacttacttccaaggcccagttttcaagatatgtattctgtattattataattttactaatattattcatcgcttttgccagccacagaccccacacatttcggacttaacattatgactgcgcatgtccgtgcaccgcggcccaattcttgtttttttttttttgcggagaaaggaaaattatcttcaagcggaatagggccagctagtattgctcagatgtgcctgtggagagccgtgctacagggtaccgtcagcccctgagtataccagagagtacaccgtgcggagttcttccagaaaatgaaaagattgttctcagaataattcgtagcgcttgataataatccgaatttgagatacctgccggcacccattctgttatcgccaagaggacttttaggggacccgcagacagtaaaatttttttcattcattaacatgtgaaggcaacattcatcgatctccatccctactgtcaaaaatataagtatatatatatatatatttatatagtctatatatatatagtcccactctcaaactaatataacctttacaaacctgtccgctcagtacggtagtcctattttattccgtttactagattatatttgaagatatttttttattcttgaaaatcccggacgatagtatttttagctgaagaatatttgcggggaggaactatatagacactcgaagcaagaggggaaaaggagaaagaaaaaaaggtacactaaacaaggtcgagtgtattgatgtcaagtgcttcaagacttcaaaacgtcaatattgtttctaacaactattctcgttacggaacttccgtttacgataagttgtatcatagtaacggcagtggtagcaataatgctggtaagaattctaccacagttggtaaactgtcatctatctcacaaaagtccaggagcaaacagcgtcatggctcaaattgctccagatcaatgagtcaatcacccttatcgacgttcaaatctccactcagcaatcaaaatcaatccagcgctcctgatgatttggcttccataggtcagagacgcagtgacgacgtcacatctttagataatgaaactatcataacgatgaattcaaggaaatcaaggattaaaaaaaagtataaatccttaatctccacctcttcaaaaaaatttatgaataaattgtacgatcatggtgcttcatccgactcattttctatattttctctgaagacttcccattctggtaaacatgaaaattccagatttgaaaagctgaggaagagaaaataccatgcttggggcaaatttgccgatatcaacgatttaccagttgaaataattgccaaaatactttctgaattcgagttaggtcgtgatcaaaagacactcgtaagatgtctatacgtatcgaagaagttttataaggcgacaaagatcgtcctttataggctaccttacttcacttccacttacagagtggcgcagtttgtcacctcactaagattacatccggataacggggcatacgtgaaagtattggacctatcacacttgaagccgggaattataggccaagactcgaaggattctcaaggcctagacgatgatggccactcaaggcgtcacagacgccgtcgccgcagatctactaacacaagtttgaatctacctccagctactccaacatctaccatttctaacgaggatgatgccaatagcggattaatcaaagacgacgcttcaaatggcagtgaagttgaagacttggcattagctggttggagagactggagatacagaaatgaacccctttatagctctcctctgttgaacagctttaaactgaaaaaagtggtttctcgttcttcttctatcacttctacatcttctggaaattccaccggtgttcactctacaaggagacaacgttccaatagttccgttgcttccataacgacgagtatcatgtcatccatctataacacctcccatgtctcattgtcttcaaccacgtctaataccagcaatggtaacatctcttctggtagtaatctgtcaagagtttccactgctggatcattgaaaaaagcttctgcgaagtccacaaggtcatctcctcagaaagcaaaacctatatctgacattacgtcatcttcctggtttagaatgaggttaagttcaagaaatagaaaggcaaggacagctaatacgattaatttaaagaactcgaaggataagtctgacgatgactttaaagttttaaagcacgattcggggcatccatccaattatcgttcttcgacattaaaatttagcattgaacaaccatttagtacgcatcatccgtatgccaacaaatttcttttaaagtacgctccttataaagatctgcccctaggttatattttacatatgctgaacctgtgtcctaaccttgttgaactaaacctttccaatttagttatttgtaccgatttcaaattaatcaaccaaagatccgaaagaagaaggatgacatcttcactgttgcccgctgtccaggagtctagtgtttctgcaggccctgagaaagatttagaaattgtctatatgaccgattctggcaaaggttatgaatattatgaggggttaagcaagaaacactcacgttcttcaagcctaggtaccaatccatctagttggattggaggtcaggcgaattggacagattacccacctccaatcgatgcacaaacgaaaacaagagaggaacacagacgcaacaataccttgaacaataagaacgtcgtattaaagaagctaaacccttttgaaatttttgaaatgatctgcaatagaaatgaagaaaaaggtggctactgctccttaactaaggtgaaaatgaatgacattgtgtggtgcaggcaatatatggtaaagtattttgtaatgaggagctggcgaaacgatttggattataaatccatggaaaacaactcttatgaaagacacttattcagtttccgggactctggcttggatagaaatttttcctgggcttgtaatgccaaattgcatgaatttgtcgcattgatggttatggatcatctttcaaatttagatgatttaggattagaagagctttttaatatcaagtccgaaaagctatatataaaaaactattgttgccgagacccggatattctcgaaatatcaaacttatttgatattagatatggggccggatctgaggctgatgctacttctgattccaatctcgaagcagaatctttacaattcaggttgacaatattaaaaacagaaaagccaacttcattttggctcacaaaagtttccaaagattatgtttctttagtggttaaattatgtgtggatgatgacattgatatggacaaaatgaaagttggaaaaccaactttgagaatagacagtattacacacaatttgattagtaggttaaaggagttgaggagagttgatctaaggagaaatgttggcgagaatagctactatgctggaagcatcatatgacgcctgctctcttttaacagcatacgttctgttaatttatttgaccaaatattattgatgtttatttttttcttttttgcatagcctttctacatttcatggctttatttatttatatttatttttcgtttcctatttttttgcatacatagacactacctttgatttttgcttgtaagatgtacgatataaagtatactatgaaaaatttgaaaatattggtcttagttactttttctggtttgttttatcaattcatgtagcagtgtgcacgaaaatctagttacgcaatgtgaaatctagaaaaccttctacaatttggaattatcaatcacctctcgttgaaagttttcacacaccaattctggacggtcgaagcataaattatgagaacagtcaggtaaaataatcactttacgaagacattctttatttatagtttgtttgtaaaattccaaattttcaataggagctataggatctttttcagcgccaaatattataattttctgtttcatatccgtttgcgtcaatacaccattgaatttaacccaatcaacagtttcccatcctagtaaataacctatgatggttctacttttgttgcttatgttgtttttaaattgccagaacttcctgtatttcaacttgacatcatcaccttgttgataaaaatactgcttgatgccggaactttgtagaccttttacctgatcgaatttgtttctataaacgtcaaatagccatggcaatttaaacacaccatagagagcccactggataatatgtttatccttagaaagctgctcgatatgtgctttggggggcgtcaacaaaactagcgtttgtaccgcttttgtatcagccatgtgctgctcgtaaagatgacatgccagaaaacaacccatagaatgccctacaagcactatcttatgaccgttaaatggatttacgttatcattattcggcaccgctgtagaccattttcttaagacgtcacatacaagaacgaaaataagttccaccactttcagcatggggtagtcgctccattctgaactatgaccaaagccgggcagatctaacgtcaaaaatgccttttgatcagagtccacaagctcgagtaagggttcaaattgttctaagttgccagccaacccaggcacgaagacgaaaacagtatcaccccgtatccctttatcgctcaagttgtgacacgtccttattcttgaatttcgatccgatagttgttcattaaaaaactcctcatgttctgcgataaacttcaacctaaagtccaaatctacctctggtttgcgaatgtaagctaccaaatcagctgcattttctgcattttgaacaatctcttctagcgtctttccagaaaggggctcacaggaccaactttttgttgcttctgcacgttctgccatattcattaccaagagaaaaagttctcggtttaaggctttcttctaacgttgagttacgatccaaatgcgactgtaccatcttggtagttctttattaatgaaccctttaaaattgccgggttaaaagaatggcgcgtcctcttgaaacttttcgaagaaaacaacgtaactgatggttaaaatttgcataaagaaggtcaggcctcgtctgcggacaacaacactatcaatatccagcgtgcaattatgtctgtgcaccacaaaaagaagctaatgcccaaatcggcattgctgattagaaaataccaaaagggaatcagatcatcattcattgggctcatcatagtgttatcctttttatttttcatgagtggctcaaggtccccagaggtaccaatagctcagggcaccagtgtcagtcgtgtagccagtaaggattatttgatgccgtttactgacaagtcacaaggagtaatccatcccgtggacgatggaaagaaggaaaagggtgttatggtcacattggccaggaattcagatttatggaacttggtaaaatctattagacatgttgaagacaggttcaataacagatatcactacgattgggtgttcttgaatgaccaaccatttagtgatgagtttaaacgtgttaccagtgcattggtttcaggcaaggcaaaatatgggacaatcccaaaggaccattggtccattccatcttggatcgatactgaaaaattcgatgagaaaaggcttgcaatgggaaaattggatattccatatggtagttccgtgccttaccgtcacatgtgccgtttccagtcagggttcatatggagacacccactactggaggagtacgaatggttttggagagtggataccgatatcactttattctgtgatattcagtatgacatattcaagtttttaaaagtaaataacaagaaatatggattcattctttcggtaagtgaatatgagcgcacaatcccaaccttgtgggaaacgacaaagaaattcatcaagaaaaatcctaaattcttacacaaaaataacctcatgaaattcatttcgaatgatgatggtgacacttataatatgtgtcatttctggaccaacttcgaaatcggctctttagacttcttcaggtccgatgcatacagagaatactttgattacttagacagttctggtggattcttctacgaaagatggggggatgcgccagtgcactccatcgctgcctctttgttcttggacaagtcagaaatccatttctttgacggtcttggattccatcatccagatttcacctcttgtcctatcgaacagaagattagactacaaaacaagtgtatctgcgaacctagcaaggacgtcacctggactcctgactacttctgtactagaaagtacttttcagcaggaaattacaagcttccaccaggaatttaaaaaccaaactacaaatagcgcctgctccgtcaaaacaggtgctaaaacgtcaacatgtatctatctatatacacataattcaatgtagtagccacctcacttcattctagtgccttcttgggttcaaaaatgggtgcggtgcggccggagatgaagagagaaaagcaaaattgtatctaaaccagcctacaaaaacacaaacttgatattataaagaatcaagcatcttactgaacttttgtcctctacagaaaagcgaaaaaactctaagaatagagaactagagtggtgttcatatttctagtcaccatggcgtttgaggattatttttctttccagatattcttcattttcttaaggaaatccttagaaattgttgtcattgtttctatcctgttgacgatcgtcaaacaagatctgtctgttgaggacgacagcccgtttgaaggaagttcctcttctgctggtcttccaagtccaaatacgaacacaaacgcagattcgaccactgccttcttacaagcagggccttcagacggtaatgctattggaacgtccgctacggctgctaataataaatcgaggccgctaaatgtggaggaagaagaagaaatttacgagtactctaatgagcttagagaccaggaccgcgagtccgatgaacatacggctgacaacgttaagctatatcagaaattaaaaatacaaattctagcgggcggcgcatttggtttgttgctgtgtatgttaatcgggggtgcgtttgttagtatcttttatcatattggaaccgacttatggacactgagtgaacattattatgaaggtgtcttaagtcttgtcgcgtccgttattatttctgtcatggggttgttttttttaagaatggggaagttaagagagaagttcagagtgaaattagcttctatcatttattcaaaggacaataatttgctgggaaacaaaacccaaaaaggtgtgaaattcagtcaaaagtactccttcttcatattaccatttataacgactttgagagaagggttagaagctgtgtattcaattggaggtatcggtattgaccaaccactatcctcgattcccctctctatggtccttgctactgcaatcagtacggtgttcggtatttttttcttcaggtactcaagttctctttcacttaagatatgccttgtagtcgccacctgcttcctctacttgatcgcggctggtttgttttccaaaggtgtatggcaacttgaattgcaagactacgtcaacaaatgtaacggtcaagacatgagtgaagtagaaaatggacccggttcgtacgacatatctcgttctgtttggcatgttaattgttgcaatggtgaaaaagatggaggttggatgatttttactgccatttttggttggacgaatagtgctaccgtcggctctgtaattagctacaacgcctactggttggtattaaaatacgctttgaagcttctaatgatagaaggaaaatgcggatatatcccatatctacctattagctggcaaaagaaacgtattatgaaaagattaagcattgccaaggcatcgctcgatctcaaacatcatacttctgaactcaactctagcacatcagagccagacagtcaaagacggtccaaagatagttctgtgcccctaataattgatagcagtggttcagcaaattgagaacataacaaacacacgtaataattttaagcttcttttcatacattttacagtaaatactatgtacatatatattcgtcattaaaaatagctagaaaaaggcatgctataaagactaaatgagtgctcctttgattttagatgccaacaaaaggtaattcatgccaatgtctctatgacggccactatgtcaccagaatcaaccatatcaccattgccatggcaaatcttgataatcttacccgatttaggagcggatataatcatttccgctttcatggcttcaataattagtagcccttgacctgcttcaataacatctccaacagatgctatggatttccaaaaacgcccagaatactcagaatatacaatttctgcaccttctgggaagtcttcttcctcgtcaggtttgactgtgacactttcttttagttcagagtttgcattttgaatcaatttggcaaattcctctgctctttcaccaagctggccctcctggaatgctgtgatggaatctttgtttgcgttgatccatctcaagtattcttgatgatcaaaaacactcttttcgatattgactttataaacaccattatcacaatcttcagtcattttatccaaatcttcttcagaaactgggtaaaattcgacttggtcaaatgggttcatcaaccacggaacctcagaagatgcggccagacatagtttgtcccaaattggtattgttctacccactaattggtacccaccaggactgttagcagcatatatgcacatatacataccgccaataccgactgcacctctttctgtatatgttctacttgggttgtacttgcttcccaaaaatctgtgacgaggatctaatggaacagcacaaggcgaccctaggaagacatcacctaaacctaaaaccataaatctggcagaatacaacatatcataaacttcattccttgaaattccatttacattggcaatgaaatcaacgttatttggcaaccatggagcagacgaacgaattgtttcttgatacctttgaacacatgccaaagtcttcgagtcttcgaaagccatcggtaatcttattatattagaagttatcttccaattttcatcaaactggatttctgtttcatatgccaccaatactttaagcaattctttttgagtgactttgtaaccatcaaattctatcaatacagatctaacaccttgggacatttcaacaataccaatagtcttattctttttcacaagggagatcaggcattcaattctataggaaatattaaaattcatttcattatcaccgtattccaccaaaacataacgatcacctgcttgtctgtatacaacctttggtgaaagctcattcactttttccatttgtgcaagaataggcgtttcgaatgatggtaaaattgaaacagagtctaagcgccttaacttagtaccatccaatgatttaattgcaacatcctgagattcctttaaggatctcgagctttcgtaagaaagtggcacaaactgaatggaatcaccgggtttaacctgtccaaccttccacagttctgcttctgggacaacagcttgacacacaaaaccacctaaggaaggaccatcgcaagtaataataactggctcatcacccgtgaaattaattgcacccagagaataaacgtaatcgtgagtgtttgaaggatgcataccaccttcaccaccattacttcttgcccacttaggtttaggtccaatcaaacggacaccaaatctattggagttgtaatgaaccttccacttctcactgaaaaattcttcgatggactcaggtttaaaaaaatctggagacccatggggaccacatgttacaccaattctccattccttagtttcggaaatttgaggaattaatgattgaggaatattctgtggaaggcactcaactgatttattttcttcattgcttggtaagaatagtacgtctccaagttttagcacccttccattgtatccaccgacatttcctagagtgaaagtagaataagagcccaagtatttaggcacatcaatgccacccctgatacctaagtatgctctacagccgcttgtcaacttgccaatggataaagtagatcccctcttaacttcgaccggtttgtgttggggaatttcttggccgtctaatgtacatagagcggtaccaccagtaatggcaatgacagtttcacaatggaaaacgatggatggaccagtcaacgttacttcaatggcaggagtcctgtagtcattaccaacaattctgttcgccaatctaaacgaatatgcgtccattggaccagagggcggaacaccaattctccagtacccaactctaccggggtaatcctgaatactagtgtgtgcaccgggcaaagtaatttcgatggcggtaggctcatattgataagagttcaaaatgtttgtagaaacttttgctttagcaaagaaatcactggtaatgatagacttcaggtagtcaatgttagtaatacatccgtaaacttttgtttcttctaacgcttgatttaacttggaaattgcatcatcacggtctttcccatgaacgataattttggccaatgttggatcatattcgggagaaatattagtacctttcttaacccaagtatccactcttgcccaatcaggaaatttcacatcgacaagtaaacctggagaaggtctgaaatttttcaatggattttcagcatataaacgtgcctccattgaaaccccattgacttctacctttgtagaatcaaaatcaggtgcatcattagcggcaatcctgatcatccactcgaccaagtctaaccctgtaaccatttctgttattggatgttcaacttgtaatcttgtattaacttctaaaaagtaaaactcgtcctttttctcatcgtaaataaattcaaccgtaccagcacacttgtaattcaataaagatcccaaactttcagctgcctttcttaacgccaacctcgtcttttctggcaaatttggtgcaggagtttcttcgataactttttggttacgacgctgtaaagaacaatcacgttcgcccaaagcaatggccttaccaaaaccatctcccataagttggacttcaacatgcctggcattttcgataaaccgttccagaaatacaccagcgtcaccgaaaaatgtttcaccttgatgtttcacagtctcaaaaatatgctcgatgtcctcttcagaatcgactttctgcaaaccaataccaccgccaccagcagttgacttcaccataactgggtattccaattccgctgcgactttcttagcctcttcaactgatgtgataagcaaagagcctggcactagaggaacgccagccttctgtgcaatctgtctagcagaatgttttaaccctaaacctctgataatatctcccgaaggaccaacaaaggtaatgccagcactggtgcacgcatcagaaaaatccgcattttccgacaagaaaccataaccaggaataatggcctgtgcattagtttgcttagcggcatctatgatcttattcatgtctaaataagtttgggctgcggttgtgccatgaaggggtacagaaacatctgcatcagtaacgtgttgagaatatttatcagggtcggaataaactgcaactgatctaatacccaatttttttaatgtcttgataatacgaacggcaatttcacctctattggcaattaacacggtatcaaataacttcttcttttgggactcttttttcttcaacatttcaaaatatgctctaaatccaccatactttgtgatatcaactgtacctttggctttgtaaccagattcttcacaaataaaggatttgatccattcaccagattctaactccactgaacctattcctaatggttcaggaaccatggaaataaaagcaccgaacagttcttttggaacactgtacacttctaattcgatttgagagccattgctatcttgaactcttctcaaaccaggttttaaaactggtccatttttgggcaaagcaaaaagctggtaagcttttgatgtttttgttgtacataaatatgttgcattgaccttttccaattgccaatgtagaggcagacccttaagatgtgcaccgacaacagccaattttatggacgtagatgggtcatagtctggtcccactaattgatcgtttgctggctttactgaagaagaggtaaaagtaccgtatgttctggaaccgttggggaatatattttggaaatagcggttagccaactctaatagtgcgtaatctgtgaattttttaccgattaaagtaataccatttggcaaaccatcgtctcggaaccctgcgggaacagcaagggctgccaaatctgccaagttgacaaaattagtccatgtgccttgtcttgaattgactaggactggttcatccgcaacttgttgcatagtaggatttaaaggacatgtgggcacacacaatacatcgactgattcgagaagtcgtctcactttttgcaagatgccttgtcttttgtattcaaaactgaagcagtctactgcactgtatttcttggccccttctataattgaaataacagtagggtccaaagattcctttggtggtttactgtccaaaaacgattgaatagcttgataacgctcggccacccaagtaccttcgtataaacagcgagctaactctaaaagaggctcaaaatcaatttctatgacgttagcgcccgttcttgatagattttcgacagcattggaaaacagtacaggattcttggtttcaccataccatgggatatttttaggaatagcaatcgttacattgcttgaaaattttttcaaagggttggaaacatagggtctagaatattcatcattatcaggatctggctggcacatgatgcggaagcagcgttcagcatcacttaggtttaatgcaaagatggagacgcagtctaaagatttacaagcgggaactacaccttgacaggaaaagacgccctttgttggctttaggccaatcaggttgttcaaggcggctgggactctaccagaacctgctgtatcagtacccaatgcaattggtacgatacctctggcgaccaccgatgctgacccagcggaggaaccaccagatacatgctctttgctaaaagcgcaaggtgttttcccatatggagaccgtgtgccgactaatcctgtggcaaattggtccaagtttgtcttacccacgattatcgcacctgcatttcttagtagttctactactttagagtctttggaaggctcatatgcaaaggatggacatgcagcggtggtgggtagacctctaacgtcgatgttgtccttaacagcaatagggacaccgtagagaggtagagtttctttattttctctgctctttaaaatttggaattggtgcagtaaattttcctttgaaattagcgatatccacgcattatcgactggcgcaacattttgagagtctagtagtgattcaagaagccttagtgaagcctgggagcttgatgacttgtggaaatcaatccagtcttggattgaccaacctaacgatatttcagcagttgtatcggaactaactgtcattttttaatcaaaactgaaatttattgtgactataaaaaagatatttctattttttatcttttatattaatgtaaattgaaatttggtgtatatcagctgctccactgatatattaatataagcttataaaaacttgagcctatatgatcctagaaaaaaaaagcttagctaagagagcctgatattcagaagtgagcgagtatacaaatctcacacctcatctgctctagtgtttaaatacaaacattcaatttccaacaacgtctaacaaagctcgattcaaattaagaagcaggaaaaagcaaaacatctgcgtgtcttatctcaatggcttgcgctaactgcgaacagagtgccctatgaaataggggaatgaacgcatattggtttcattatagagcgtcaatcaagaaagaggcaccaaactataaacgcacatttctcggtagggctaggaacgctttcctgcttatcttatctgaagcttatttattgttcgtttttttatcttatctgataaggggaaaaagcctggaaaagcgcgtaaatgatgaggcgaaatgcagccaaagatgcgtgccgttgcagttagctaacaacctggcgttcggcgatcgccataagagatctgccaattttaaaaagggtattgccaatacacatagtagccttatctgcagcaagccataggactaatgtgttcgacgtcgttggggaaaaaaagcaaagaacatgttgcctttgaggagactgcagcaagaaaaaaagttcaataaggattgcaaaaaaaaaaagaagctcgcactcaggatcgaactaaggaccaacagatttgcaatctgctgcgctaccactgcgccatacgagctttctattacatgtgggaagactaatatagatagtatagtcaattatacgaagtagtgccagccccacatataagagaacggtggaatatttgaactgtatgcaaagaagtttcagcggggacctttattttagaaaaagcgaataaatgtcgctcatttgtttaaacggtatttgttggactgagggttgcttccatacggaaatgctaacgaagaggatgtgctgaattttgctatgtttggaatgggctcctccatctgggaatgataatcatttttattattgtgtgttcaaatacacttacacatctgttttttcgtggtaaggaatccgagaatcacatgaggtttgggatagttgctggcaatcaatgaatgacatcagataaaacgaaaggagaaataatatgttgataattagaggttaaaaattagtattaatgaagaaataattactgatcttcttatactaaataagagaggtatataaaacacacgccgattggtcatattaatcatgaccaatataatagtgattccggtagttactatacattgatgtgacgactcatattcctcatatatgtacctaccataacatgttcaactaataggtctttaacacagcttcagtattgtctgagcttctcgtttaacattccttctgcaataggcgcaatcacacttaaacgtatacgagttgtacattaatatacgatgtaagcattgaattgttaccatagcaactcatgtcactattaattactctcgttccaacataatattattatggagtaatatctattccctttcgtggattccaagattctcgaggtatatttccagtatattttgtatacctgatattatagcctttagcaacaacgaaatcaacatttatctcaaatttcacctgtttctcatttttaagcgcctagcccatctaatcatcttaactattcatcagggaaaattaatatacattgtgctcttaatgtttcgaaaaataatcaaaatcaatagaaatagcgttttgctactaacaaagccctttgatccaaagttggcttctgagaacttaacatttcagtagaacaagcctcaagcttaaatgaagaatggcaaagtaaatgagacctctctctccatattttgctcagagcctgttaaggaaaacaacaccgcacattagtgtgaaaaactttccccgcaagctgttggaagatgaatcatttattatcttttgactgttagctacattactagctgttatcaatctctcagacgattatatgaatattgagatagttgttgggattaacttattgttagaggctatagcatcagatatacaaaataaaataaaaagttctcctccaagatatagtgtaatcgatatttcgatgtaatgccatcattatttcttctattttatgtattcctattgtcctctaacattgtatctgataatattctagtaataggattaccatcactaaatgatagttaattctcattccaaaaccgactcctgtcaatattgaggacccatttattccaacggtccaaatccccaatattccctgctcggcaagaagttagaaaacatatctttcgtgctcttgcaggcttgctgtattatcataaccgaaggatgaccaactttgatcaccccaggtggcaaaaacataatacatggtggtggtgtcgttgtaaaaatcatcttctttgggtgtgtataggatcccatccaacacacgtgttaaaatgacatcaggtatcaatgctaatccgtcgtcactgacaataagctgagttgacatcacctgatgatgtgaaatagtagcaagagaactagggtaaggttcatgctggttgttttcctatgatgaccaacctttggaattgggtaattctaggtgtagcctgctagccatcaaacgagacctttcaaaatcttcagtcattacattttcttctgtaaatagggaaaaaagcctttagctaggattgttcggcaatagaaagccctccagtttaaacttgacatagaaaatctttaaggttaaatcaaacataagttattatccgatatagtgtaacggctatcacatcacgctttcaccgtggagaccggggttcgactccccgtatcggagttattttttgtttctataccattatttttcttgaatgttgcattatgatagtatagttttgctatacaaacttcaattctcaaaacacagtacgtctagctcactactactctctctaattcaaaatcgttcacttctatcgaaagctgtgataatttggaaatattgtcgtgggccacgaatgatttttcaattacattgctaaatacgaagacattaatacctttattcatataagcactttcattatcattttttactaaagataaaactaactgcaggcaccaagaagttcgaagccaagagtaaagatgtcaggaaccggattatcgctattcgtgacgggtcttatactgaattgtttgaattccatttgccagatatactttactatattatatggtgatcttgaagcagactatatcaactcaatcgaactgtgtaagagggtgaataggttgagtgtaccagaggcaattctacaagctttcatttctgcattgtttctttttaacgggtactggttcgtatttctcttgaatgtccctgttctagcatataacgcaagtaaagtctacaagaaaacacatctactggacgccacggatattttcagaaaattgggtagatgcaaaattgaatgctttttaaaattgggattttaccttctcatattctttttctacttctacagaatggtcacagcgttacttgaaaatgatgcaaatttgataagctaatagcgacaacaggaaaaaaaaagagagatttgtgcatatctatgaagtatgtctaccacataaaaatgaccttataacacaacttccttagtatggaagtaatacatatatacatatatacatatatacatacatatatatatatatatatatatatatacatcttttgaaccaattccctatagacttggttgtaattcgttagaaagattttcattaattttatttatctttttcagaagtccgttatatggatccatcaagtctacgaaatgtgcaatatccagaatatttgagtcatcccgtattgaatcgtcctcgctatcttggctcataattttgcgatctccctcgtatttgcctagcaaagtagaagtcaaatcatttagcctcttatttagcttcactttgtcgttcagtttggcttgttcattttgtaagtcatgccagtctttaccggctttcaactcttgaatttcatttcgtaccgatattatctgctggttcaaatcttcttttcgagcaagtacctgcttcagttggtagcagagctcattattcgacacgttgatatctaatatgtctttcaagtctctggtcatttggtctgatatcgtttgaaagagtcgcagatctaatttgtacaatagtttcctaaattgatcatcatcacttttattgaaatccttcaaagcttgcggaatcaaatcattttcaaataagtttatgaataaagaagataaaacatcaattgtggtcacagaagtgatagacgatgatagctgtctaatgggtatatcatcgaaattgtaacgagtagtaaggtcttcatcatttctaacattttgcggcgattcgcttataagacttttattttcagagtcgatcatgggatagtcttctgcatccaagggctgatacccatgttcatgacggtcctgcgcatttacgttattagtggtaataggaaactcgaaagaattcgcaagttttggtgaagacaaaatgggttgaacaggagattgaataggtgagttctcctctctataaacagcatttggcgtcttaaatacaataacatcatcatctatatcgtctgtccttcttgaatgactgcccctcagcctaaaagctaatttagtgtctctatccatactgaggtttttctttaaatgaacacgcaaatagtcaagacaatacagagcaacacaggacacgtaaaaaaatgagagcaatcgcttcttatactgcaacgatgttgacccttgccataatagctaatgaaatcaatcattatcatttctactagtcctttaacaatatttggatacaccattaaatttctccgtacaacacgataaaatattttctaccagcttcaaacggctgtgaaggggcgatagtgccgttccaaaaagcgttccccaaacttgtattcaagaccaaatcttagtcaagcaagcagtttcgcaccttcatacactccattaaaagtgaaaataagcatatttgtaattaaatctggttatcataccctgttccctttagaaccaatatacatagacgcagtcgacaaagaagcaataaaagagattaccattcttattcactatttttttttttctctgactcttcatagttgtacggaaaaccatctgcgtgttatatcctagttccaaatattctgatttctcgtgatcgaatctgttatattgtcatatattgtaattccatttttttcccggttcattttttgatattctcttcctgttccaatattaataaaggaggcttttttctttccctttcgttctgatttatattgtttttactattattggatcttttaaatattacagctttttcatatccttcgccatcgatttttgcctgaaaaatttacacaaatgatgtctaacgttgctaacgcctcccaaagacaggaaaatccatatattattccattgcctccttcatccacagtggaaacttctactgaacccccaagaacgttatggatgggagatttggatccgtccttcgacgaggccacgattgaggagatatggtcaaaactggataaaaaagttatcgttaaactaattagagccaaaaaaaatttgttgattccttgtagctccacctcaagtagtaataacaacacaagtgaggagaatgctgaaaaccagcaatctgcatcaaacagcactgatcagttagataattcccaaatgattaatattaatggaatatccttcattgatccttccactactcaattacatcatgccggatactgttttgtcgaatttgaaactcaaaaggacgctaaatttgccctgtcattaaatgctacacctttacctaatttttattccccaacaactaactcccaaactaatccaacgttcaaaaggactttcagattgaattgggcgtctggagctactttacaaagttctataccatctaccccagaattttccttgtttgttggtgatctttctcccaccgccactgaagctgatttgttatctcttttccaaacgaggttcaaatctgttaaaaccgtccgcgtgatgactgaccctttaacaggatcatctcgttgttttggatttgtcagattcggtgatgaagatgagcgccgcagggcactgattgagatgagtgggaaatggtttcaaggaagggccttaagagtcgcttatgccacgccaagaaataatatgatgctgcagttacaggaacaacaacaacagcaacaacaattgcagcaacagcatcagcagctagatcaggaggataataatggccctctcttgattaagactgcaaataatctcattcaaaacaatagcaacatgcttcctctcaatgccttgcataacgcgcctccaatgcatttgaatgagggcggcatttcaaacatgcgtgtaaatgattcactaccttcaaacacctataatacagaccccactaatactactgtttttgtgggaggactggtaccaaaaactaccgaatttcaattacgttcactattcaaaccctttggacccattctaaatgtcaggattcccaatggtaaaaactgtgggtttgttaaattcgagaagaggattgatgctgaagcttcaatacaaggcctgcaaggctttattgtgggcggcagtccaataagattatcatggggacgcccatccagttcaaatgctaaaacaaattcgaccatcatgggggcaagccaatatatgtcctcaaatggcctgagagcgccatctgcggcttcttcagtcgataactccaaacaaattcttgaacaatatgcggaagataaaaggcgactctttttacatcagcagcagcagcagcagcagcagcagcaacaggatggtaacttttctatggagcaaatggcgcacaacaactattacaactacaataattacgattatcacaggaacaagaatggcagccatagcgacctcgttaatctgcagagatctaatgtcccgtatatgcaagaagacggtgcactgtacccacaccaatattcaagtccctcatactcgctccatccgacgggcaaccaattctccaatgctactaataacttacctcaatttgggaacgcgatgtcaatttctatgcaactgcccaatggcaacagcaataaaacggcctcaagcatgaacacaaaccctaacacaaacatgatcatgaattctaacatgaacatgaacatgaacgtaaatccagtaccatacggaatgggaaacggtgcaaatatgtatgacgtgtccaggatgatgactcctcccttaaatatagccccgaattccaataattcgaaatcgagcatcatgaacaagcatcctaataggaacaatgttccgccaattcatccttctcttctacattgattacaaaagacaaaaaaagaaaattttaatcttgtccgcagttttatctgcgtctctacgttcttacgtttcttctattaatgccatttcagttacaacctagtcaattgtcgatccataattctaatcaaatttgtttttcctctatactacctatctatttttatctatctaagtacatttatttactcaaacagttccgtttcaaagtgttttatattaactatatatgcgaaaagctggcgtcataatttcacgtgttataatagccatgctgacggaaaaaaaatgtgaaaatcgctacaaagtccgatgactacgggcagtagcatgtaaatgatggacacacacacacacatatatatatatatacatttacttcaataaaaggctgtgccagacatttttgccatacattgttcatgaagtgtgcaaaataagagagtgtataataggataaaaaatggtcaaatcgctacagctagcccatcaattaaaagacaagaaaatactactaatcggaggcggagaagtcggcttgacaaggttatataagctgatacctacaggttgcaagctgactttagtatctcctgacctacacaaatccattattccgaagtttggaaaattcatccagaacgaggatcagcccgactacagagaagacgctaaacgctttatcaatccgaactgggaccccacgaagaatgaaatttacgagtacatccgcagtgacttcaaagacgaatacctcgacctagaagacgagaacgacgcgtggtacataataatgacctgtatacccgaccaccctgaaagcgcaagaatatatcacctttgtaaggaaagattcggtaagcagcagctggtcaatgtggcggacaaacctgatctctgtgacttttatttcggcgccaacctggagataggagaccgtctacagattctgatctctaccaacggcctttctccgcgctttggcgctctagtaagagatgagatccgtaacttattcacacaaatgggggatctggcgctggaggacgctgtcgtcaaactaggtgagctgagaagaggaattaggctgctggcaccagacgacaaggatgtcaagtaccgcatggattgggccagacgctgcacagacctcttcggcattcagcactgccacaacatcgacgtaaaacgtctgctggatcttttcaaggtcatgtttcaagaacagaactgttccttgcagttccctcccagagaacggttgcttagcgagtactgctcgtcttgagcgacagggcctcctcttttaaggggcgcgtcctttctattgtgtagagaaaatctactgggattttgtatatatttcgcatatataggggttggagaacgaacaacaatgcctgttcagatcaacttttcttctatcttatcaggcaagatcaggcacacaacccaactataataactataaacacttatagaacaattaccgtttcttccttcacacaacatggcttctacttcgaacacgttccctccaagccaaagcaattcttccaacaaccttccaacttctagacatgcatccattgtggagatgctgtctactccgccattgctgccccacgttcaagtgaacgatacagacgacaaggaacaaccagaagagtccacgccgccaacagcaacagcggcagcgcctggtccaggttgtgctgctacacccgcccccttgcgcgatgaaaagcctcaattcaaactatcagctgttcctatgacccagacgccatcgcagtgtctgtcatgtgtgcacgcccaaaaatggcaacacataccgttgtcgcaattgatcgaacagaataagcttatttttgttccaggttccatatcggtagaggaggcattcaacactttgatcaagtatcatctaaactctattcccgtggaatctttccccggcgacatgaactgttttactttcgactacaatgaccttaattcgtaccttttgctggttttgaataaaatcaccgtcagcaacaaacagcttactgcagattgccagaatggaaaacccgtaccagtgggcgaaatggtgaaactaactcctaagaatccgttctataagctgccggagaatgagagtttgtccacggtgatggggattctcggttcgggtgtccatcgtgtagcgataacaaacgaagagatgaccaaagttaaaggtattttgtcccaacgtcgtttgataaagtatctttgggacaacgctagatcttttacaagcttagaacctctattaaactcctcattacaagatttgcacatcggtgttctcaatattcaatctaagccaacttcaagacaatcccgtgtcatctctattcaaggcgaggagcccttaatcatgggcctttataaaatgcatgtggaaagaatttcttccattgcagtcatcgacaaacaaggtaatttgctaggtaacatatcggtaacggacgtaaaacatgtcacaagaacctcccaataccccttactacataagacatgtcgccatttcatttctgtcattttaaactccagaggattagaaacgggtaaagattctttccccatttttcacgtataccccagtagttcactagcaaggactcttgccaagttagttgctacaaagtctcatagactatggatcgtacaaccgccggagtcgtcaacctcggcgtcatccacaaatttaacagctgctaatactgcagccaatgcagtttctgccaccgctcaatcgtctgctaatggtgcgactccaatgtcaaagtcatcctcttcaacatccctcaactcccactctccgttgatgacagcaatggaagacccaccatccccacgttcttcggccatcgcgatcccaccaccaagtcccgcttcctcaacaaacacaccaaacctattcgaaaaggaatatagaacgggtaagttgatcggtgtggtctcattgacagacatcatcaacttattagcaaggaaacaaacagggaataaagaagtggatccgcaatccgcaagaagacagagaggcagtatcgccatgtgaggcttgcagcgttgtcttttcccgctgtttccctctccctcaaaaaaaaaaatcttttacaatgactaaaagaaaatattgttcatttatatggttttaagtattttgtagacatttaagcgtatatacttgttctgaaaacatttatatattctattttgtatattcaacttattaaactctgacttttgctattgtcgcgtatatgtatatctttttttcttgtcgtggaaaattaaagcaaaatatgtcaggcgaatgtacacacaatgcagaaactgatgcggttaattttgcattctgaaacgatttaaacgaacagcattaacctccacgaccatattcaaacgattggaaatggaccaaaaaggtatgttctggctttattttcaattatccgcccttcgttaggggtgttttagatcattttgattaacaattctatttatgatagcaattgtccttgataactctaaaagtggtagtaaacagacaaaatcgagtggcaaaatgcaaacgcaaacagatactaatgctgaagttctaaacaccgataacagtatcaaaaaagaaacaggaagtgattctgaggatcttttcaataaattttcaaacaaaaaaacgaacaggaaaatacccaacatcgctgaagaattagcgaaaaacagaaactacgtaaaaggtgcgtctccgtctcccattataatttctggttcctcttcaacttctccatcaggaccctcttcctccagtacaaacccgatggggataccaacgaatcgatttaataaaaatactgtagaactatatcagcattcaccatcccccgtgatgactactaacaagactgatacagaggaaaagagacaaaacaatagaaatatggataataaaaacaccccagaaagaggatcttcttcctttgctgctaagcaactaaaaatatcatccttgttaactatatcctccaatgaagatagtaaaactttgcatataaacgatactaatggcaacaaaaatagtaatgccgccagtaataatattccatcggcttatgcagaactccatacagagggaaatagcattgaatcactaataaaacccccaagctctcccagaaataaatctctaacgcccaaagttatcttgccaacacagaatatggatggtacaattgcaaaggatcctcatttaggtgataatacaccaggaatactcatagcaaaaactagttctcccgtaaatttggatgttgaaagcactgcacaatctctgggaaaatttaacaagtccactaattctttgaaagctgccctaacaaaagctcctgcagaaaaggtctctttaaaacgtagcattagttcagttacaaacagtgattctaatattagctccagcaaaaagcctacgtctgaaaaagctaaaaaatcaagttcagcatcagcaatactaccaaagccaacaacgaccaagacatcaaaaaaagctgctagcaatagtagcgattctaccagaaaaaaaaacgcctcgaacaagactacatcagccataaagaaagagtcaaatgccggctccaaattgaacactgttaagaaggaaaatagctctttatcttctatcaaagccactgagaaagaaaaagataaaggtggaaatagcacggaagcaaaaaactctaccagcaacgttagaaaggaaccaactgcaaaatccccaaaaaggttagtagccgcaccgacagtcagtccaccaaaaattctacaaacggcagaaaccaaagcaaaggaaccctcgatattgattgacgttccattgtatcaagctgatacaaacgactacctagacgaaaacggtcaggttatttttaatttatcaactttaataaaagagaagtatcacccgaaaagtaaagaactagcacaacttaaagactctaaaagaaatttattaatgcaattatccgatcattctaacggctcactagaaaaggaaaaagatgaagaaggagatgtaatagaacttgatgatgatgaggatatggaagaagatgaaggggaaatagatacagaaactaatactgtaactaccaccatctctccgaagaagaagtcgcatcctatgaaaggtaaaaatttgattggtaaatatgacgttgaagatccgttcattgatgattcggagttattgtgggaggaacagcgtgctgccaccaaggacggtttttttgtttactttggtccattaatcgaaaaaggtcactatgcaagtttggagcgtgcaaatggtaccatgaaaagaggtggtgttaaaaataaataagcattgtgtcagagattttccaaaatccctgaacgacataaaaaatgaaataaagtgtgcctatatctgaaagtatatagtcagtttatatgaagatttttccgagcgaatgcttttctatccatgtatctatgtccgataatatggtgaaagaaaaaatagataatttcaccttagagaatctataaacttggctataaaaccagaaacgagtatggcatgttcaatatcttggtggaaatgaaatagataagaacttcattttataccagtaaaatagtcatttagagattcgtttttatccacaatttccttatacttcggaagtttatcaggttcgactgacttcaaattagaatcaatcttcgaacaaacaatcttcagtagatcttcatcccatgttttttttagcacaatgaaaatattcaagtaagttagcagtaataatatatcactcttcttggcatctgccgtaaatgaatcttggatagtctgcagacaacagtcatgaacagctttcattttggaagaatctagttggatataatgtctgatgttactttgctgagctttgttactatcattgaccttcagtttggataatttttcgacaatcaaatccgtctcagaatcgttatccttggtggagatgcgtcgccttgaaaggtctttaaaaacacataatacggacgtcttagccaatggaaggggagatgtcttaagcacatctaagataaactcaaatgcaactttttcaggtattaaacatagtaatctggtgagaagagtgaaagttatcattcttaactgctgattgacctgaatacagttcttttgaagtagaacatgcaataatgtttttgtaacaaacactgaaagattcttcaattctttttttacatcctccaagggctcggttgtaatagcataccatagccagtagcgactaactgattcaactgctacattatagtaaactttagaatataatgatggagttgtaaatctcaagtagagataaatggcatccgttatattcatttcctttactaaatgttgattggtttccaaatagtggataccagaaaataatattacaccattatagtccaaaccaacatttttttctttagcggccttttgtacttcgaatgtataagccaatttatataccattctttccaaaaccaactttgcttcatcattaacagcggaaatctcctggggtacagacttataaataatcctacattcttttatcacattctgaaattctccctctatatcaacatcaagcgagaacgccatttggtaatacctgcaaaatagctcaagatattcggtgtaatatgcagataattcaaacttctgttgatttagtgcacaatagtatttcacgtcggcattggtggtgacagtttttatgggtgtcgaaataccaaaagtacaaagcctacgcaatagtctaacctgtaattcactttcttcctccacaactttatcaaacatctctcgagtaaaatcttcgttcaattgtatatcttttggtggatcagggggaatatagttcctgcagaatgtgtacaccctacgaagaaggaaaagggcatcttcaaaagtgtccgcatgactatacacaaatttctcaattgttgacacagcagctcccagatatttcgaaggaaacagagtagaaatccttttcagactcgcccctatgaattcaaataaaatgtaggatttcaacttcaagaaaaattcatttgaactcttgctttcaccgtaggatggaaaatcttttcgattagaggaattttcgattactccttcaggaggtaacgtattggcctttttatcaacaaagtcttccttattctgttgatcactcttggaaaaatcttttgaacaaagggatgaaagcaactccaacccagtaattaaacattttttgggctcgccttggattgagatggcatagaaacacttcattacaccttggacaatcatattcgtacctagtcttccatttacatcgacattatcctttgacaagaacttcaataatcccttaggcagatcccaaccgatttcaccagtagtactcggattatcctctaacaatgtattcaaagtttcaatgaatctcgtcttttcttcatagctcccctcttggttaacttgctcgccatatatatcaatcaatgttaccaactcaagaagatcctccttctgagttttgaacgcatcagtaacctcaaaaagtatgtcatcaattggttccattagtgtctgagtatcgtattgaatgtctagggtgattttctttttcagtgtttatttgttaataatgttcaccggcaattagtctttatttttttcctttacattgtcaaatttaaagaatcgtacttatgaaggatgcccgcttagtgtttgacagaaagctacttgagctgaagaaataaacgtacatccctaactgtatattctacagtagagtgaaccaatgacagtatgagtaggatcctagagagcgaaaatgaaacagaaagtgacgaaagctccatcatatccacaaataatggaacggcaatggaaagatccagaaataatcaagaattaagatcatctcctcataccgttcaaaatagattggaactttttagcaggagattgtctcagcttggtttggcgagtgacatttctgtcgaccagcaagttgaagattcctctagtggcacttatgaacaggaagagacaatcaaaacgaatgcacaaacaagcaaacaaaaaagccataaagacgaaaaaaacatacaaaagatacagataaaatttcagcccattggttctattgggcagttaaaaccatctgtttgtaaaatatcaatgtcacagtcttttgcaatggttattttatttcttaagagacggctgaaaatggaccatgtttattgttatataaataattcgtttgcgccaagtccgcagcaaaatattggtgaactttggatgcaattcaagactaatgatgagcttattgtaagttattgtgcatccgtagcgtttggttaaatacccgggcgctggaatggtctaagaagaaaacctacagtcgatcaaaaatcccgtacgatattaaatagagtagttaacgtacttgagcgttataaactcacattttcactcaagaagaaaatggagaatggagacatggtaagtgaaagcattaaggaagaaacacagttagcacgtatttcatcgaaagtgtttgattactttctatttggcatttaaatatacatgggaacataactagataaaatatacgccatatatagtacagctagtattttcagatgtcataaaatataattaacgagtaaaaattactttttttgggatgggggtagggtttcttcttctaggacaaccaacaaatctgatgcgtcaacactttcaccatccttaatgaaaacgtctttaacttgaccatctgctggtgaagagacaaccatttccattttcatggcactcaaaacagcaatcgattcgccctttttcaccaaagaccctttatgtactttaacttctatgataacaccagccattggtgcaccgatttggtgagtatcgtggacatcagcctttggtttagcaacagattgtatgttttgtgacttgtctgcaactctgatctttcttaattcaccgttcaattcaaaatacacttctctttgcccagttttcttatttaagtcaccaacagcttgcaatttgataatcaaagtcttaccttgttcgatggtgacttcgatttcttcatcaggttctgctggtgctaggaaatttttggttggtagaactgataaatcaccgtatgtttctctgatcttttggaaatcttcatagacccttggatacatattgtaagaagcaacatcgcattcatcaatatcaccgaatctgttctgcaagtcttctctaattttttcgagatcaaatggttctaattctaaacctggacggcacgtcaactttcttctcttgtttctcaatacatcagatcttaatggttctgggaacccaccgtatggttgaccaattaaaccttcaaaaaagtccataacagagtcaggaaagtccaaagaattagctaaacgtctaatatcgtcggaagtcagtttgttagaaaccatgaattgagctaaatcaccgacaaccttagaagttggggtaactttaacaatatctcccagtaggtaattggcttctctgtaagctcttttagtttcagcccattgttcaccaagacccagttgttgagcttggaataacaagttagtcaattgaccacctgggatttcatgttggtaaacttctggatctggtcccttcaagtcggcctcgaaacaagaatacaacagtctcatttcggcccagtatgcatctaattcacgaacatgctcaacgttaatcccagtatcaatgttaccttctaatgaagccaacagtgcattaattgatggttgggaagttaagcccgacattgaattgatagctacatcgacaacatcagcacctgctagggcacatgcagtcatagacgcaacagcagtacctgcggagtcatgactgtgaacatgaattggtaaatccggatatctggttcttagggagccaattaataatttggcagcggccggtttcatagtacctgccatatccttaatacccaagatatgtgtacccatttgaactattttttcaacaacttctaggtagtagtctaagttgtatttcttacctggctgaagcatgtcaccagagtaacaaacagtagcttcgacaacaccaccggccttcttgacagcattcacaccaacttttaattgttctaaatcattcaaggcatcaaaaactctaaatatatcaacaccattatccttggcttgcttgacaaaatggtcaatagcattgtcaggtaatgaagagtaagccacaccgttggcaccacgtaataacatttggaatggaatattaggcaccagagatcttaattttctcagacgttcccatggatcctcatgcaagaatctcattgcaacgtcgaatgtagcaccaccccaacattctaaagcgaaagcacctgcaagggcatgtgcggttgttggagcgattgtagccaaatcgtgggttctgactcttgttgcaagtagagattgatgagcgtctctccaggtggtgtccatcagtagagtaccattgaactgtctgacttgcttggcaaattcagatggtcccttttccagtagcacttgtctccatccggatggtggtgcagactttgtaacgttgatgacattgccctgagcatcgtgcaaatgggggacacttggatttgattttagttttggcaagccaatttgacccttaatagaagaaccgttaactgccaagtctgccaaatagtgtaacagtttttgcgctctgttttgtgacgataccatttggaacagttgtggggtgtcgtcaataaaagtcgtccagtatgtaccctcaataaaaactggattggtcaaaagagtcaataggaagggaatgttggtcttaacacctctgattctgaattcgatcagggcacgaatcatcttcctacggacgatttcataagtagaaccagagcatgaacatttgaccagcattgagtcgtagtgaggcgagatagtagcacctgcataagcgttaccaccgtccaatctcacaccattaccaccggcagaacgatagacctccaggcgaccggtatccggttggaaattcttagagggatcttcagtggtaatacgacattggatggaaaacccacgggtggtgattttatcctgtaatagacctagttgagtcaaagtggcacctgcggcaatctggatttgggcagaaacaatgtcaataccggtgatttcttcagtgatggtatgctccacttgaattcttggattaatttcaatgaaatagtgtctgttttggttgtcaaccaagaattcggcggtacctgcgtttctgtaaccacataccttagctaatttaacagcatctgtcaaaatagcgtcacgaacttcacggggcaaagtctttgctggagcgacttcgacaactttttggtgtcttctttgcacagaacagtctctttcgaaaagatgaaccacgtttccgtggttatcagccaacaattgaacttcaatatgctttggcttgtccaagaatctttccacaaagcaggtaccattaccgaaggcagtacgggcttcggaggtagcacgttgaaaggcatctgccacgtcgtcaccttctctaacgactctcatacctctaccaccaccaccaaaggcggccttaatgatcaccgggtagccgtattcattaacgaagtcaagtgcctcttgcacagtttcgataggtcctggagtaccgggaacggtaggaacgttagctcttgctgccaagtgtctggcagagactttgtcacccacagagtcaataacttcagctggagggccgatccaagtgataccggccttcactactttgtcggcaaattccgaattttcagacaagaacccataacctggatggatgaaatccaccttatgcttctttgcaatttcgatgatctcgtccattgccaagtaagcacccacaggtgtatactggccctcctccccgataacatacgcttcgtccgccttcaacctgtgcattgaaagacggtcctcatgggagtatatggcgatggttctcatagacagctcatgagcagatctaaaaattctaatcggaatttcacctctattggcgaccaagatcttattcttttcgccgagcaaactgaaattgtccctaagaccggccaatttcttgctactgctcatattttattttgttctctatgtcccttattttctctcctagtaactgtcctttattttgcaatatagtaattggcaaaaaaatcaaactcaaatgacgggccacagatagtaagctacaagagtttggaagaaaagaggggcttgtttatgtatgtaatcaagtaaggataccgaaagtaagagaaaagaaaaaaggactaaaaatcacagaaacacaataggaaatatccgatggggagtacttcttacttaacactccctgcgccaattctgactcttataataaatagctcgagacgtaactgccaaaattgtaaaaaaaaaatgaaaaactattagaaaattaattgcgaaaaaaaaaaggttagtcatatgtgcctttgcggcgtcttccgcaggaaggacccctctctgccaatcacagaagagctggctgtgcctgtgcggtacgctatcagcagctgcgtcgggtaagggacacgtcgttagtgacaatcgtggttagttttcgtacagaaagatgaccttaattgataattaaagtatagaaatgtcgtatagtatatttttcccttgcatggaaaaaactgggataatgtgatgattctcattaacagatttacactggtattgatactcattttgtttctgcttcctgtagtacataaaaagatcttgtaaatattacgatactcgttaaaattttcttgaacgtaatgtcgtacaattcttgtttgaggggtcgttacgtacatctccaggaactgattggcagactttgtaaatggaggattttccttttcaaatatccaaaatataggaaaagtccgactacaatacatatgagattggtgatgtaatagccgtcacgcaggatggtcacggtgccattcaaaagctcggtgcacgcttgcatgctgccgccgtgagttacgtatactttatttgtgccaggaatagtgcactgatacacggtgaagtagttgatcatggacataatgattaaccgcggccatgtcccaccgaagttgctgagggtatttaacaatgtcatatatgtgccacccagcacggggtctgcaactcttgtatggaaggccgatattccaatgaactggacagtattcatgaaggaacctaagaggtgctggaatatcacgagacaaaaataacccgtggatatttcaccatccttggggaattgcttcaccacgtaacttcccaagaccgcggctgccagacggcccaaaaagccccacaaccatggtgttaaaacgccggcatccccaactaagaacttgatgaccttgttggtgcccgtgctgtttcttaatcttctattgtcacgaatcatggggtccttgtcggagctccatttaacaacatagtacccaaatatgatttcgaacggcaggtctatgagtactgtcacagccaagtcttctcttttgaagccttgctctagtagtttcaggtttgtggcggcttcgttgcattgaaaggcaaatttcgaaatcatgtgaatgaaggctaggcttcttacggacttcaatttcaacacttttataaagcagcggtaaatgtactttatactgcttgtattctgagttgacaccacatcaccgtcgtcatactcaatacttatcggctttgaccctccgtcacttgtatttatgggctccactttgggcaaatactctacgtagggtttttccttggtgcaaaagatgatatatatggttattacaatgtaaagcatgcccgagaatttcatgtacccaccaagactaatgaacccgtgatccagtgggatgtttctgaaatacttattggcgaaatcagaggaattcaacgacaggaaaatggtaaatgacataaaataaccaatattcaaacctattgtttgcgcggtagatgcatatgatagggattctttggacaaaatcgtcaacgcccaaccatcaactgcgatgtcttgagtggcacacagaaaaactaacaggccaaaccaccacgtcaaattttttatactgacactgtgtaaagtgccattaccgcgattatggaacgcatcgtcgacaccatcgaagattatgccttgtgatatgcaccaccctaatgcccatagcacaaatccactaacaaattgtactggaatgatccatgatcttcttctaccgatgcgcttgttgtacagtgagtctactattggtgaccatatgatctttaaagaatatggatatgtagccatagagaaaattcccagtgatgtaaacgaggtctcctttgctaaagatttcagtagaaacggtacggtaccgaaggccaatcctacaggtatgccttgagccaaatataacataattaaaagataaaattgcggcaaatcatgcttggctagtgacccgctctttcgcttaggttccatgcctacttttgttttatccccctataactatggtatattatactgcctcaccaaacgtttaggtcttgcttctgcttcccacagtagcttacgcattatagccgatttatttttcacttattttcgcatgccagagtatctttattttctttctttcattcagcctgtcgtcgaaaagaaaaaaaagaaaataaatatgtgcgtattctaaccatgaaacaggaactcattcaatgtgcacagtacttatctcattcaattttgtaaaaacaaaatatatacattgtatgtatgtgtgtatttgcagttatatatctactaataaccagtacgccatacatgtcttgattagcaaaatattatttatgtttttctcattagtactatttccgcgaagagggtagaaagtgtagggtacagggaaaaaagttccctatctccttctttctctccttcctattggattgaagtttatttattcaattgacaagacttctttgacagctttaacgatggttggagtatcagggaaagcgaaatcttctaattctttagcgtaaggtgttggaacatcggcaccagtaactctttggattggagcatccaagtaatcaaaggcttcagactccataacttgggcgacaatttcagcaccaacaccaaatgatgggaaagtggattcaacagtaatcaagtggtttgtcttcttgacagttttgatgatagcttcagtatctaaaggtctaatagaacgcaagttgataacttctgcagagacaccatatttcttttgtagaatttcagcggcttccaaagaaaactgaacgtttcttgtgtacgtaacaatggaaatatcggtaccttctctttcgatcttagccttgtatggcaaggtgaactcaggggataaagcttcttctgagatttcaaaagattcaccgtacaacaattcgttctctaaaaatacaacagggtttggatctctgatggcggcctttaacaaacccctagcatcttcagcagaataagggacaaggacctttaaccctggaatggaaccgtaccaaggagaaaagtcctgtgaatgttgagcaccaacacccactgcagcaccattaggacctctgaagaccatttgacatttttgagtaccaccagacatgtagtgagtctttgcagcggaattgacaacatgatcgatagcttgcatagagaaattgaacgacataaactctacaattggcttcaaacccttcaaagcggcaccaacggccaaacctgtgaacccgtattcggtaataggtgtgtcaaccacacgacgttcaccgaacctgtccaataaaccctttgacaccttataagccccgttatattgtgcaacttcttcaccaataaggaagacatcatcatcacggtccaattcttccgccatggcactattcaaggcctctctgacggtcatcgtctttgttgatgagaatctcaatgctgctgctgctgcagagggtcttacaaaagaagttggggcacgacgtgcaacatttctggccaatgatgttggcagtctggaaaacatgttgaacaaaattattgcaaaagtaaaagaacttactaaactgcgatcgattatcaatgaacaaacacaggaactgttatgagggaggcggaatttaacgtccgagtgtgtaaatgatactaaattagtctaacaaaaggaagaaacttgacagagataatatcaagagtcgctgttgcaatcgttaacctgtatatgtagatacacctctttttattgcaaacgtgcaaacgcatgacttttaatgacggagaacttcttagttgaagactcgtctcttttgcatgttctcccacttcgaagtctcggaaaacagaccccggaaacagccgcgacgaaaaagaatcagcttaggcatgataaatactgtggtttcattagatagataaaatacataagtattggcgtatataaacgggtgccagatagaagctttcagagagcataaaattgtacaggatactgcctacaacttactcttatttctgctgctcttagcaaaagtttctgcgataactcttctctggattttacctgtagcggtttttggtagcttatcaacaaagtacaccttggttggaattttgaaagaggctaggtgcttctttaagaagttcaccagttcttcgtaggtcattttttctcccttcttcaaaacaatggcggcttgaactacttggccgtacatatcgtcgggaacaccaaatgcaacggcttcatcgatctttggatgcgatagcataatgccgtcgagctcaatgggtgaaatcttttcaccacccctgttgataagctctttgattctgcctgtaaggaccaaaaacccctcagggtcgaaataaccttggtcaccggttctgaaatagttctctctcttggtgaagttctccttgttagcttttggattattagcataccccaaagtgacgttttcgcctctgatggaaacttcgccgactttgcccgggggcaagacattgtcattgtcatctagaatgacgacggtgactccttgtggctggcccacagtaccaggctttctctttcctggaggcagattgtttgaggtcatttgatgtgatgcttcggtcatcgcataggcctccaagacaggtgcattgaattccttctccagcttatggaacgttgctggagccaaagcagaagaacacgatctgatgaatctaatgtgtgggaaagggtttggtttgggcatgttcagcataatcatgcttattgtgggaacgcaactgaaccaattacagttgtacttaacaaattggtcccagaataactttggatggaatccatcgggaaccacaacagaaccctgagttctaaaagtggaaagtaaaacaccaattaacccatggacgtggaaaagaggcatcacgacataagatctgtccaagggcgttagcttgtaagtgttagcaatgttcaacgtgcttctcacaatgttcaaatgtaacaaaggcaccgtttttggagtggaggtggtaccactggtatgcaaaatcagggcaacgtcactggaacgggcaaacccagggaatttaacgggatttgtgttgacaaatttggcgttgttcaaagaccggtaaataacccttttgtagttgtcctctggagagtatatatcatactctaccctaaacctggtcgcatcgaaggccagctctacgataaaacatccaaacgtggaggcagattttagaatttcagaactctgtaactttgtggtaccctttgggacgcaaatcgccttagatttcaggtcattcaaataaaaattgaactccttttccttataattgggattcaagggcgcgccaattttagcgtccatagtagcaccgaggaaagcgacgataaattccagcccattacgcatggatatcgccactgtatcttgtctgaaaacagctccgtacaatggagaattaggatttgtgaacatggtctggaagtgacccaccatgtgggatagatccctgtaggtcacctgagtgtccgtttcaggaacaataacggcgacattatcggatacgctaaaagtatcgttgaacgaagcagtaacagtagcggcacttgtcattgtagcaaaaatgtgcgtgaagcgtctaacctcttgcagcacagtgggagtaaatttcaagaaggagcatctattaaaaagagcttttaatcataccatctctatttatatacagttaatcttgaaaaataaaaaaagaccgaataaaggactcggaagctttagctcggaatagttaaagacgctttcggcccgagaaaaaaatattctgagcaccaaaatccaatcgcctgaagtttatcaagtaaatttgccattcctggccccatatagtgatgcctaagtggacagcaacatcgcgctcttacttgttagtcgttctcatgacgagcaaggcaaaagcactcgtcctcagctaagtcgtatggtatgactggcagcgtgaatggcacggccacatgggtgggattacccgcgcagcctctacggtcacgtgtaaaagtacggcacgtgaccttcctggtatttgctaacctgcgactatggtaaagcactcctgcttcataattgcgtggttttcttgaaacggtgccccatgctgtttggctgaggtttgccgaagtataaaggcaccattctagttctttaaatacctgcgatgcatcacagggccctgcggagtttgttgcacaatgcatgtaaaacttagagtgcgcgggcgtcgtccctcgtcttctagtaaccatagcagggtcttgcttgtaaaatactttgaacttgtttcgcagcatttcgtagtagctctttttctgaagatattgaaaatgaaaccacccggaactggaccactttaagggactggtgacaaactcttgttcggtggggaaaataatgtacggcttgatttttctctgcgaatattcattaatcaatgaattcgttggcagtatttctgctttcttcctcccagcggtgtcctttgctggaggggacatgattccggtaaacagaggaatcattagatgtgtccataagttttcgtctcgcgctcttgatagagatgtccctatggatgaagtttgacatagataatgttttgcagtatcactagcacttgtgccagcagaaagtttttctagtttattgtaaaacgacagtaaacccgacgactgaaatttggagggcgtagaatatacaaattctaattcgctcaaaggagcaaagttaacttcctctacgctttttgtaatcaattcgtcaatgtctttcaggtggtacgaattgaggtattctatcaagcttctcttaaacggtactggtagcccttctttacctattttcaaaaggggactgcaccaacacacctgttgaggcaggttagtctccattgacgtaaaattgttagatggcaagaatattttgcattcgccattatcgtaaaagtttatgatcagcttcgtatggtgggaagcgaatgggggcatcgttatttcaataagtttgaccttttttaatattactgccagtgtcgcgtccatagcacgggcttcgataggcataatagtacccttttggccgacgatggttatgttctctacgttctggtggaattgtctcaacaagaaatcaagttcgtattggaaactgaagagtatgcttctttttagtgtctcagtgccaaagatatctttcaatgtaatcatatcctctacttctcccataaaatcctctctttcatagaagtccgatttcattagtttaaaaacggcaccttttgccgtatcgtttgtttctattctctcactcaaatcttgttcctgattagtcaaatcaatgattttcgattcactgactatgacgcagtcgtcgctatcattgttactgttgaccggagccatattctccatttcagcactatacctgacgctcttccaccgttgtgctactttctcggcaacatccgacctcttcctcttagttccattgaaatttgtttctcgtgacattaatgatcggttgaaaacacattatcatcattcttgtctgggctcaccgtttctctgcattattttcctctttataagccctttattaaattaccattttcgcagtttagtgcggccgccgaaaatacatcagaagggatccataccaacacttaccaagaacgctgaaacacgttgttcacatcacctgaaacaagcagcagctactggagaagtgtgtaaagtagtagtaattattaaaggacacatattgaaggattgttcaattttcttttttattatttttcccctcatttatccactttttataaactgctcaagtaaatacaatgggctccaataaggaagcaaaaaacattgatagtaagaatgatagggggttaaccagtataaccagtaacaaaatttccaacttaaaagcacatgataaccatacaagttcaatgattactgaacataaaaatgctgacaaagaaaaggggaaacaagaaaaagagagtagaaatggaaccacgcaatcaagtagttcagtagaatcacactcaccacaagtaagccatcattcagataagctctcgtcctttgattcgcccttacatttgccaaactttagactggcggatgacttgttctcaaactcgtcaagacgatcatctgactccgctgcctcatcctcagtatccaaactgaagtccgctcagctttccaaaataggtctacatcatcatcatacaagtaataataaacatagtcatagaagcggaactccgacttccgaagtgaaagctaattactcaccagacccttctgcaccgcgattcattgtatccaatatggtcggcaatggccggggaggtggtggtctacacggtgcaacttcgaacgttgtcaagaaactccattctagaaaaaaatgggactggaacactttaccggcatcagattcttctcttctaatcaaaaccgtttcaggaaatcataatttaatcaacatttgcatagacggtgaattcaaacaaataatgtacgacccgaatcataatgagctctttaatagaatggacttgtttctatcttttaacatggactcctcgccagaagactctttaatatttgccaagaaaagattacggtcgtacattgatttcctaacaaaatatttggaatctaggaaatatgcatttgaatgttatccatttaacattgaaaacatcataaatatagagactgaggttaaatgctttccatcgtttgacccgttaaaagattattctgaaattgaatccttgattcaattatggttggctcaatctcaaaaatttttactgcaatcaaattcattcttcttttcatctgaagtagtggaggaactaataaaaagaaaaccaaccacaagacaacattctaatccaacaatcagcaccaccagcaacaagatcagtgaccctacattatatattcagcagttagatatagaagcaaactctccaaggccagtaatatcggatccattagacgaaattgacatcttattaataagaccgctgcataaaaccctgggcggttggcagctggcgtatgatgaaccaagcttgaacatcgcagatttcgcattagatttatctccctggatgattgacagcagtgacaatgacgctcagaataagaatgctagtgaaattgctcctgagtatttaacaaacttacaaaattatttgccacgaaagggttcaagagcgaaaatagtttctgacgaacaagaagttatcgaattgaattcttccaatgcttcagagtatatgtatgattgcatgaatagaaagttctttacagatgatgcaaaagaacgtatttctagaaacaacttcaatcagggagttgaggaagaccctctaaacgaccaattcgcttcaagtagatctttatcattgccgtcctcgggagcagatgctgtcaaaaggaagaagagccctaccaaggctactaaaaaatctggtttcgtcaactttttcaagagaaagcattctcaacttgcatcaacttcacatactacaagcccttcagtttcacctagcatatcttcttcttcttctccaaaaattcaaccacagtcacatatctctagtccccctcggacagagaaagctccccatgtcaaatcagccaaccaagcacatcaaaatgaatggttggagaattttttttgccggactttgaacaactacaaagaaatcgatttaccgacccaatttattttgccaaaggaagtgaagaggtcctctaatgcacaacttcagcctgaagatgaaccacctttgtcatcaccaatatcctctaattcggataactcctttccaaatgaaggacttgacagggcaaaaagcgcagctatttatggtaaagaatatttaaaattaagactgccgtttgcatcagacactatacctgctgtaatatgcccgtgggtctggacaagtttaagttattataaatggaaagctctacttagggaaatatacagatcaataattcctggcgggtacgcgctggcaattgttccagatttaaggatttcaaacacatactatactggaattcttggcaacgccgatgccgaaaaagcaaataattcatcagaagagtttttgactacaaaagaacgggacaagacatttgatgctatggctattgatgcgataaataaaggcttacatatccatcctacaaaacacttaacgaggacattcaaggatgtagggtttacaggcatcaagtcctcggtcctaagtttgaaaactggtgacttcaaaacagatatgggctttttgaatgaatttaattctttagatatgtgggactacatgttaaggaggcaactaccagatagtagttgtcctccaaaggataccgaccccaccactcttttcaaaagatatgtggaagaacacataggaaaaatcgatgacaacgctggctgctttagaactttgtatgtggtggcgcaaaagccaaagctgccatataccaaataattgtgccgccgttccaatttttttttaaattgttcaagaattacttcaatttttactactggacaaaaagcattatgataaggagtagtctcccagtatcgtagaaccaatttgaaacactttagccaatatttattaattttttttacttcccatggcatagtactttgtaggaagattatttgttcatttactacatttattacatctatatttatatattctataccattcatttttttttatgttaagcttctcttgggaattgttggggtatgaatgttagcagaatgacccaactctttttctagcataactcctaattttttatcttcttcagaaacgtcacgaattaaactgtccttttcatcaccagaatagtattttacgtccacttgggaagccaaagagtgctctgtttcctgtaacgagtcgacagtagcttcgtcgattaaaacgtatgctatgttagaacccgggcaatcataattaacgtttagcagaagtctttccattatccctctcaaccctctggcgccagttccttccttgagagcaaattgagcaactttctttagcgccttttgtgtaacacacaatcttaccccaaattgcttaaaaatatattcatattgatccaataaggcatttttaggttcttttaatatatgaaataaatcgtctctttgtagaggctgcagagcagttataattgggactctgccaattaattcaggaattagaccaaagctaactaaatctgtgggggtggtcaagtctaaagcacacactttttttccgttatctaattcaacctgctcaagcgtattgctaaatctgaacttcttcgctctttctttttcaacttctttactattcgatgattcaacagactctcctgccttctgtattttcttcatatcttctatccttttaacaatatgcttatctaaaccaacaaaagctcccataatcatgaaaagaatatttgaagtgtctacaacaaatacttcgtccttctttgttgtagtttgatttttttgtccgtcaatatcatgcttaacaggccttttaacggtaatttccactttatggccctcaatgattttcaataatgactgttgaaccccttctccggacacgtctttagtgccaatgcttgcggcaggcttggctagtttatcaatctcatcaagaacaataatacctttttctgctctcgcaacatcaaattcagcatttacgagcaatctttcaatgcatacttcaacatcttcacctatgtaacctgcttgagtcaattgtgtacaatctgtaattgcaattggaacgtttaatattttcgccaatgttgttgccaacaaagtcttaccagaacctgagggaccaacgacaaggacattacttttgcttaactctaaatcttcgtcaacctctctacctgctaaattaaactgtctttgaagattcctccaaccagcctttgattcgctgtttccactgaaaattggttcatccctatcatccgcgattttctctcgttccatcaattctctctgcctttgtaattcccctttcttttgcttgtcattgattcttaaatagtgattataaactgccacgcttaaaaccttcttaccaatctcttgaccaacaatgtactcatcgaggaatttcttcaatgcttttggagtgggtatattcgataaacgagactgtgccagtttccctgatgctgtagcagcatatcgaccaattctactagaataagctctaaaaaagttttggcttgcagatttcaacatgagtgtgaaatgtaattagagtgccttgtcttctatggttttgtttgatgagccgtttgcttttctttttaattttaatatataccactgatgacttattcccttctatcatcgaaaaaatattgtcaaattaatgttctcttttttcaaaaaatattaaaaagataagaaaggtaccatgtcgcagaaaatacagcagcatcagtttcctgatttttattgttgttatctactacaatcgattaacaagaggcaatcattttacgttggatcaactcctaacccagtacgacgtttgaggcagcataatgggaaattggctgttggaggggcatatcgaaccaaacgtgacggttcaaggccctgggaaatgataatgattgtgcggggcttcccaagtaagatagcagctttacagtttgaacatgcatggcaacatgggtaccaaacgcattatattgccgaaaaagatcgtgttgtaaagcataaagcaggtggaagaactttacatcacaaagttgcattaatgaagttacttttaaagcatgaattttttcaaaggatgaacttgatagtcgaggtttttaatataaaggcttgggaggtttggaaacaggacaaattttttattgaaagagacagatttccgattaatatacaaataaatgaaaatgcgcttgaagaaccaaaggagaaaactgtggatgttctcatggatcatagtgatgagaatttaaaagtggtggaagctgtatacactaaagtcattgaaaatgaaagaaacatattcgaaactttcgaaaagaaactaactacaggggtagtgcgatgtgaaatttgtgagaaagaaattgactacacgtctgaagagcaaaatctgaagccgtttgtagcgctttgcaataataaagactgtgggtgtgttaaccacttgaaatgtcttcacaggtactttctagatgatgaacagttgatggtagggagaagaaatttgatacctcgaggtgggaaatgtccgaaatgtgatatgttttgcgactggacgaccctagtcaagttttcgacaagaatgaagttagctcacgggaagtagggcctgacacaattttcggttcttttttttctatagataatggttatatgttatatttacggatatttttacgtttactttgtaagaaagagctaaaaagatgtaaagatatcacttcgtttttttccctcaaaaaataacttcccaatcttcagttatgtcaagcgataggttaagaatggtgatcttattatcattctcatatgacgatctagtcggcaatgaactttcttcgccattttttttgactttaatactgtctttcaacgttatgttgtgttgtaaattattctttgcgataatgattttttcaatattggtattcctcaaagtattgtggtgaatgcctgtcaaattctcgggaatatgacttcgaacattttttaaggtattgttttcgaaaatgaactgagtttctacgtactcacctctttggtagccaaaagtttctccatcatcaacataaagatctccaacggctcgtccctcggtatcaggggctataactattacatatggatcgtttttcattaacattgaagatcttctatacttatctttcatagtgataatgtgaccgccttcaataaataatggaattttatccaatggtgcagaaatattcttttctatcaaatcagtaccattgtttataaaagagtgtaaagatgcgaattcatagaatataccgggtgggaaaaccatttccgtttctgattgaccaggctccgtgacaggtttgactaatagacctgaattactccagtaaaattggttatcgatatgatacaattcagcaaattcagggtgttcaataaacattggattcattatcggaaatccagtgacacttgatttatgaaacatggtgtataaggtaggtagcaggaaatatctcaattggataatatcacgtactatcgacttcaaaggttcattgaataagtatggttctcttctcttggtgtctatatgggcgtgtgctctaaaaaatgggtaccataagcccgcttggtaccaacgtgcaatcaattcaggtgtaggatcctcagcaaagccagctatgtcggctcctataaatggcataccagcaatgttgtttgacagaaccataggaatggaaatctttaagtaatcccaattggccacattgtcaccagtccatgtggcagcagtacgttgagagccggcaaaaaaagcccttgttagaaggaaaggacgcttatcggatggtgaataaatcgattttattgcgtcgtaagtagcttcatgcactgatagaccatatatgttatggacggatctttcctcaatgtaattgtcgtgaatcaaatcttttggagctgtggtctctgggccatcgaaaatcgaaggctcgttcatatcattccaaatgaataaattagttaaatcagccggcagatccataaaccgttcgaaaaaggacttccaaatcttttggccatatttgcttatggtatcaatccatatagaattacctggccagcaatgacctacatagtcatttccattgtgatccttgactgctacattttcattaattaccctgtcactgatttcataatctttctttaaatgaggatcgattagtacgacaagatttctacccaacttttttaatttggataacagcctttttggattgggaaaggagtgctgcttccaagtaaaatattttttgtcgttcgtatactccaagtccaaccaaataaaatcgtaaggaatcatatgagcatccatctgagagtccactgtgagaacgtccatctcatcattataattccatctacattgatggtaccctatagaggaaatgggcggtaaaaagggtctaccagtcaaatcggtaaatttgtcaatgatagttggaatatctggccccagggacatgactacatctatgacaccattttcggagatccaatgagtcatcgttttatttttactggtgtcatactttatgtctacccaagtgtcagctgcattgacccaaaagatagatgtggacgaagatgaaaacatgaatgggatcgaaccgtacattggttggctggtaccgatgttgtactcaaagacatcaacgttgaaaagcctgtagggttcctttccacctgaagtgtccatcagccttagcgacgtcgcatgttccggtataccgtagacattagtagaacccatgaaagagaaatctagcgcaaccgattcaggccccaaaggcatagagtcatgctttgaatacaagaaattgtccttaaacatgttgaaagttgtttcttctggcagcacgtgtgcgaagttttcctgcttagttctatgatgttcaatgttcaggaaattttgctcgtttacaataagtttcagcgcattttgccagtaaactttcaattgaaaaggttcagcaaagatttctacggatacatcaccgtttcgaagatgaaatgtgtctgcagtggagtttgaaagtgacaaaaatgaagatattttcgaccagaatgagttcacagtttgtttttgcttaaggaagtggaattgtggaatactggtcctgttcgcctcctcttgaaatttcttgtcgaatgcgtacttccaggtctcattgaaccgttgtgaagagatcaacaaaccgctgctgttggttggcattctctctttctcatttatagtgaaccttactgagtgatcctgtaaaaaagagagagagaatgggaactgaacggctatatcatcgccctccaatcttggtatagttttaattatggtagcatgaagcacattctctaaaggatcgtgtgcaatagactcggcgtccactttgtaatagcagtgatgagatttggcaatattttctgcataaaccctgtttctatggcaaaacccagattgcgcacacttctttaatagatagtcggtaaacgcatgcgaaaaagcggtaaagaagaccaattggcatacgagccatttcaaaaggaccatgttgcatacggttgattcgagaccgctattttaagatacgcagagcaatcaaataactccaagcaacatgttcattgagttatagctctcaagtgccgtagtgagaaaatgtcgtggtccgggtaaaacaaattaagggtacttgaaatgaaaaaagaatgatagtagacagaaaagctattatattatagaaacttatcacttgaccgatgaagaggaaagcacgtttccttacaaataaatcagcagtaatagttataaaaatatatgtatataaagtgtgtgagtgtgtgagtgtgtgaaaggatgttattaaatagtatgttattatttcttgtcgtatctggagtagtatttctttgaaattataccgtccagcgtcaaaagacccagagcgccggcggttgttgctaagactgtagagttaggtttccccttcaagaatctggcgttgtggttcgcatacccgttacataaataacataccactgaagaatgcagcaacaagttgaccaagacaacgggattctgaagttctaaaaagcatactttggcaaagtcttgcgtcttactgacaaaagcttggaggtagccgcaagcgactgctgatgcactatttaaccgtgccttcagatattcgatagcgcattccttcttattgttgtggtggtgaccgtcttcagagtcagaatttgggctagcgttactgtcgtgtttagcactggggaaaagaaagatggtcatagatgatatacgttagtcaaaagagaaccgggagaaaagattaggcgatacgtttcagatattagtgtacatacgttgcagacatattatgagatgctggaggtagatgttatgtttctaattgttggaatagggttacgtcggcggtttcggttgaagtgggcacattgatcgacactttatatacgcagggacgattaacgggagaggaggtagcggcggcgtcattggccgctggcccggggtagtagggcagggaaaggggacggtgaaaaaataaaacgtaagtgggacagcagagatttgaggagttgaggcaagaacagaggagagaacgagaaagcggataagcaacaaaggaaaaggaaacaagtaaaaaaaaaaaaagagactagcatgagaaacgaattataccagttatggtgtgtggcgagtgcagcaagaggggtagccaagagctcattcgtaagggccaattcggccatgtgtgagtacgtgcgcacgtccaacgtcttgagtcgctggactcgggacaggcaatgggaagcagctaaggccctatcacaacgggtcaagaaagagtatgccgccaattagtgcacacacatacatatattttatatacttacatatttggttgcgtggtatatagaatctctcctttcgcttcatgaatgaactcattcatgcgaagtcaaaggaaaaaaaaaataaaaaaataaaagagcgaacgggaagacgagagaaacatcaagcgaccaaagtaaaagtcaagaacgactccacaagtgcgagggtcgcgacgtctctaactttaaaaacaggcgtcaaccatcaagtccgtttcttgatgccgccggcattcttcaaatccctccaaaaaaaacgcctctatgacataggcggttaataaaactggccttgaaacaacagatgcagtcatggctcttctcttttcccagcaaacgccttccattgcctcctttttttctcttccagaactctctcagcagtattctcacaaacacatctcctcccctttagcaaacctccatttatatcctgcgagaagagctccttctcctcaatgagaaaataagcacaaaataaactgggaaaaaaaatatagtaaaagacgccagcacgttaacaatggaacactcttattgtagaccaaccccaccctacaccccctcaaaccgaggacacttcaaaaggaaaatcaacaactttggccgatacttgggggataagcaagcttatcctattacatcaaaaaaagaatcgtaagacacctttccttgcaaaccaaaaatcataacaaagtcgaaaaacttcctcttgcagcgccaccagaaaaagaagacgagcgaagaaatcaacaataagagcgccccatccgcactagcaccccataccataaatattatctcccaacctactatagcaccatttcttcccatcgataaagaaaaaccaaatcccgcgttggacataaacggctcggaaagacagggaagagtatgaagcaaaaagccaaactaagggagaaacagaaagctaaaaaaaagaaaatagaaaacaaccagaagaaaacaaaaacaataaccttgagcaaccgtcgtctcaaaaaccaatttcgaaaaaccatcataaaaacgccttatgaagaaaccatgagcgaagaaaaatagcagcaaaaagtagtgagacctgacattagcggaaaacaacttgcttaaaaagtctcttcccgtccattttattattttgggtgccaaaaaatgtgtattgtaacaaattaaaaggtaatgagcctcattgaggtcatttcagttgttacactgaaaagaacagatactacacttgatctaagccaaaaggcaaagagattcgtggggatttaaaaaaaaaacaagtagaaacaaaatgaataaatctgataacaagtaaagtactcatcgatgaaaaaatgaatgtagagccctttttatatgttttcaccgagtggcccatcggaaacggcaaaaaaaaaaaaagaaagaaaaaagaaaagaaacatagagcgttgctaggttttttttgccacccacacccatacaccccattactttgtctgcagcatcgttatacacgtagtgaaagtgtgcaggcctcggcggttaaaaaaatttgagcagaaaagcatgttatttaatacatgtaatatttgtctatgaagcttcgctatcctgctgcaactgctgagcaagttgttgccggcgcaattctttgtatctctcgtcctctgcagacccgacccgctgcagaaattcttgccgggccaagaacccatccttgttgtgcagcaccaattcgtcgttaagtccagcacggtctacataactagcccagtccagctgagatttttctaatgtcgttagcttgggtcgtagcccgccagaaatgatctgctccaacaatggaggccttttcagtggccgtcgcaagtgttgccggctttcattggacttggtcctaactgctttttccagttgaacaggagcagcaggcgcctgctgcttaaatttcaaactgtttagatattcttgaccctccgcactgctgcgtgaaacccattttttctcatggacagtttcaccagcaaacttgtagtttctttcgatgaggattttgtcctcctgttgcgcggccgttgtcgacctagcctccttggaaccgtcgagaacagagccgactttccctgaactgctcaaaagacggttcttactagcttcctgtagctcctcccagatgctgtttacttttgcagggatcgattcaacagttaacgattcatacttatgtgttttcgcatattcttcctcagcttgccgagctcttctagtcttgatcagtccgccgctctcgctctctatacgcgaatagtccactttatttctacccttatctctgttcacaccgtcatcatagtcgtcaccgccatcgctggcatcactatcgtcgctaccaccacctaatttatctttttcaggctggaagtcctcgtcctcctcttctatgtagccgtcctcgtcctcgtcctccttttcgtttggtataatctttgtctctacttctggcatttataggctagtgggttttctttcttgaaacaatattattccagtttacgccttttcgtcttttttcttacttgtcgattaatcctattcatcatctttaaacttcgctctttaattcacttttttttgtctttccccgatatggtacttacacgaaatatcatgatacaaaagaaaacacgtacatactcgtcaaacgataaatacgcacctagtcgttagccgcataagtaacctttttcatattcaaacttatccatagccacatccactctaacaattttaatcgtccagcgcggcattaaataatctttctgtaatactctttagctcaattatgtccacagagactacaaaaccatcaatcactactacaccaactactgtactcgtttctcccaacacgctcaaaaggaaaaagggtgaagacaccagcgaggaacaactggaagcagaaatcaaacgcgtggccctgaaggatgcagacagccactctgacaacgaccacgattcccccgacaatgttccctctgatgtacatttacgaatgctgtgcttagtcaaacacgcttcactgatagtaggacacaagggcgccactatatctagaataaaatccgaaacctctgctagaataaacatatcaaataatatcagaggtgttcctgaaagaattgtttacgtgaggggtacttgcgatgatgtagccaaggcatacggcatgatagtaagagcgctgcttgaagaacatggtaacgaagataacggggaagacattgagatttctatcaacctattgatccctcatcatcttatgggatgtataattggcaaacgtgggtctcggttaagagaaattgaggatttgagtgcagcaaaattattcgcgtccccgaatcaattgctgctttctaacgatagaattttaaccattaacggggttccggatgctatccatattgctactttctacattagtcaaacattgctaaactttcagatggaatctccgcagaaaaatgtgaaaaggtccatatactatcagccaactcagtttaactcagtattaatagaccatagccaaccgaacaccattttccatcaaagaaaccaccaatatcatccaagcgataaactactttcatacaaacccaacaaaaatttaccaatatcatctactttgttgagtatggccacaccgcagtatactactgctagcgttgcaaacgcaacggcctttcaaccgaacttcgttatccctaatgtgacagtcttagacggccctgttatcagtccggcacccggcaaccatttattaatgaactttgtacaacaagagatattcatagatgagaaatttgtcggaaatgtcattggcaaagatggcaagcacataaattcggtcaaggaatccacaggttgttcaattattatacaagatcctgtagaaggctcttcggagagaagacttaccataagaggtacgttcatggcgtcccaagctgctattatgttgattagcaataaaattgaaattgatagatcaaatgctgaacgtaaaagaaggtcgcccctctaaatatactgctagtcaataaaaacacatagaaaataaaaatacagaaactacaaaaggcaaaaaaaataaaagaaaaggtaataaattgaatgaatgtagatatataaatatcaatagaaatacgtacgcggaattatttctctttgtaacaaattgatcaaaagctttgtattttttttttttttagctcggctgcgcgctattacagtaattacatgtaaataaactattccaaagaatacaaaagaagagcttacagtagccagtcaaagtcgctgtgaaacatacacggcgttgtagtcacagtatggaacacaatctttcacctttacagcaagaagtattggacaaatacaaacagctttctttagatctaaaagctctggatgaaactataaaagaactaaactattcgcaacacaggcaacagcattcacagcaagaaactgtatcgccagatgagatactacaggagatgagggacatagaggtcaaaattggtttagttgggacactgctaaaaggtagcgtgtactcgcttatcttgcaaagaaagcaagaacaggagtctttgggtagcaattctaaataatggtttggtgcaagaaattgattctgatgctttattttttacggtacactacattgtgctgtgagttgtaataatatagtctgtatatgccaagtgaagaaaaaaacaatacaaactcaaggtgtattatgaggtagggaatacacataacaatatatatatatacgtatgtatatttaaattgtataaatgacgatcttaccgtctaacccacaggaagagacttgtgtgatttggccgttggattccgcaaaaggtcttaattccacaatggcgttttcatgtgcactttcttggacatctgtgctaactttacctttcaagtctaattctttaaactttctcaatgcggaaataccgaaagttgaactttcatcattattaccactcagctcgtctgtattaccagatgcagttaaggcagaagacttgttattgtctgatttgtctagattcttcgcaaatttccagccttcagaggcttcgctgaacaataccggatgacaagagtatcctccacaaacaatctcgtggtcgtttatccatactaaggacctgtaaggtaaaccttccggagcattgacagattgcactggagattggtaatcgacaacattcaaagtaccatcatgcgctacataagcaattctttccatctgacttctccattccacatcatggatataagaaccctgataccactccctgattaaacaaccaaaagggaatttctggccccagggtgatccggcgacggattccttggaatccaaacccttgataaacccgctgaacacacgcataaacccatcagtaccaccagcagctaataggactccatttgcatgccaagacaggcaattgatggtagatttgatgggtttcttgatgtgcttggatacccaccaattattctcgtgttcgtaataacaaacagcgatgattctagcactggacccaacagcaaacttataaccatttggtgcccatgtaactgaagtagctgctctgttaatacgaagaagtactaacgtgggcttgtatgtcccatcactcaatggctcccaaacgtaagcattacggtcttgggagcaagtcacaatacgaccatgtatggaaatgtccacagcagtaatggttttatcatgatctttcaacgttgcgaataaaacgggaggtgtgttgtttgaaactctatagacaagacaatctgtttcgcatgtaacggctaaaatagatttatcttgagaaaagcaatgagagtagattggcgctttgaccagcttgtagacggcaacaacggacttgtctttagaattggaaaatgacattaggagactctcaactaatatacgtttacttcggcttatttttcctatttttctttgtttctaatctggaagctttctcgatcaagattgctcttatttgaccctttttcattataggcaaggcgcgggcgggtgacaagaagattttgataattgtgcaactgataacgtaggattcattatcaacattgttgttaaagagtaacaaggaaatctaagaaatggttgtgcttgttgtcgaagaagtgatagagacagtgtttttgccagccaattctctttaagaataggcctttcttgtaggattaatggttagtaggttttatcagattccaggtacgcatcggccatcgtcggcaatatcttcttcaaatgaatcttcttcactgttgtctgcaaggagaataagtcaaacatatttcaattatcaggcgacccctgaatgccaaaaagtttcctctaagtatgatcctgataacccaaacaaagataagttgggaacatacgatggggtatttgtgcctactgctttaaacgtattgtctatccttatgtttcttcgttttggcttcattttgggtcagttaggtattatatgcaccatcggtcttctgctattgagttacactattaatcttctcaccacgttaagtatatctgctatatctacaaacgggactgttaggggcgggggtgcttattatatgatttcaagaagtttaggacctgaatttggtggatccattgggcttgtctttttcttagggcaggtgttcaatgcaggtatgaacgcagtgggtattatcgaacctttactctataacttgggttattctgctcaaggcgagccacctgcagctttgggagagctactaccaagagggcattggcacgaatttacatatgccacggtcattcttttcttatgtttttctgtggcttttgttggctcgcaaacagtgtcaagagcagggaatattctttttttggtactggcagcttctatattttccattccactttctgcattgataagatcgccattcactgaaggcggtatcagttatacaggtccttcatggcaaacttttcatgataacctgctccctcacttaacaaaaggtgcagcaggttcgttactcaaaggtaaggaaacattcaatgatttatttggcgttttttttcctgctacagctggtatattcgcgggcgcaggaatgtcaagtgaattgagaaagccctctaaatcaattcctaagggtaccttatggggtttacttttcacttttatctgttatgccgttgttgtcttctccatgggttgttccattcccagaagatcgttatatgatgaagtacaaattatacagacgatcagttccgttcagtgggttatattcatgggtgaaatggctacttctcttttctccatcatagtggggatgctcggtgctgcttatgtattagaagcaattgcaaaggataacattattcctggtttggagatttttgctcattcaccgttatattcattgatttttacttggattctaacacagctatgtttgttttcagacgtcaataaaatcgccacatttatcacaatgacattcttaatgacgtttgtggtcatgaatttggcgtgcttcctattaggtatttcctctgctcccaatttcaggccctctttcaaatactttaacaggtatactacagcaattggcgcattactttctgttgttgcgatgttaatagttgatggcatctcagcgtctgtcttgtttttggctatgattttgctatttttattcattcattatttttcaccaccgaagtcttggggtgatgtgtctcaaagtttaatatatcatcaagtgagaaagtatttgcttcgcctacgtcaagacaatattaaatactggaggcctcaaatattgctgtttgtagataatccaaggacgagctggaacttaataaggttttgcaatcatttgaaaaaaggtggtttgtatattttaggccatgttgcagtaactgcggattttccgaagcaactaaatgaattaaaaactcagcagaaagcttggatgaagatcagagacatggcagcaataaaggcttttgtccaagttgggactggtccctcccttatatggggaattaggaatgtttttattggttccgggcttggaggtatgaaaccaaacattactgttgtcggtttttttgacctcgaaagttatagaaagcacatcccacaaagtcgcagccaaaataaccttcagaaacaggtggaaataaaagctacagtgccacgtagtacatgctctgatgtcaaaatcaatgttccattgcctacggatgagtgtaaaaatgaaaccaaagttaatgtacaacaatgggttcaaattgtagaagatctatcactgatgcaatccaatattgccatagcgcatggattcaaaaatttagagataccgaacaaaagggacagctgctttccaaaaaaaactatagatctttatcccatccaaatgtgcggaaaagttgaggcaaagggtgaccagcctgcggctatcactactaactttgatacgtatacactgattctacaattagctgccattttggttactgttcctgaatggaagcgcacacattcgcttcgagttattttatttgtggaacaagaatatcatagaacgaacgaaactcaacgaatgaaaaagctattacaggttctaagaattgacgcagaggttttggtagtatctttagatcaattcagagtatacaacacaattgtcaagggagacccaatcgtgtttgattatgtcaactcgaaattggccgataatgaatggtggaaagatttggttgaagctcgtgatacattaaaaccgaagcggaggttttccactattgaacctcaaacgatagcaaagcaatttacacaatcaagaaaatatacgtctggggttcagaaattgggtgtctcatttacaatgaatacgagaatgccaactaaccgcattgataccccatgcgagagtgaggactccgatttggatacagatcttacgtcaattcgtgatgccttctcggcatcgactaatatttcagtaggtaaggacttaacgaccaaatcgaagaccggttccgacagaacaaatttactcgtaaagaatttacaaagcgatgtgtcaacacagtcgttaagacccgttttctcgagtaatactttgccgaggacgagagtcgtggaagatggcacgggtgaacagccgacactgatcccaattgccgaacctgacctttcgaatgggaacggtactgggagcggtattggcaacggcaacaaattaaagaaaccggttcttcccgaattatcaccttgttgttcaaaagatagtttagtcacagcgatgcaaaatttaggtttcaatgatcttcccagcactgctcaacatttggttctgaatgatgtgatgacacaaatgtcaaagagttcggatttaattttttcaaccttgccagttccagctcttggaacacatgaagatcacgatgcaagtttacaatatgtcgaggacttggatatttggttggagggcttacctccatgcatgttaatcaattcgcaaaccatgacagtaactactgcattatagaataacacatatatcgttatgcatttccccagaacttatttactacatatagaagtcttgtaatacggccgaaatacagatgctttatagtagggttattgtttctattcatttttatttcagttgggctttacgctttccggttcgatatactgttttaccttacggaatgcaaacatggtatagaaatatgatgccgcttccttttcatccccttcaacaccatatctaccatcagatctttgtaaaccttccctcattttaggcgaaaacctctcaatccatttgggaatttcttggacaaaaaatttattaaaaggcatttgcgatactagttccaaaccgtattcatcagccaaacttcttaaggtttcgaatggcacaacatattcaggaacattatctatagcatcttctagccaataagtatacatttgaccataaggcgatgtgaactcataatcattcttttggtatgaattattctcaaatgtcactttataaatggagtttccccaagatggcttttccacttctttgggaaatttattcagtttataacgaatgaattctgaatctggtatcgtgccaaaaaagtgaccaccaattttgagtgatttggcgacattcagtaaagctctccttgctttttcttcggtctcaaaagcataatgcaagcaaaattgcgtcgaaacgatatcacacggaaatctacagtctgggaagggctctactgcaacacctaatgattcgccaaagcaatccccagtaattagcacaacttggtagtccaaatttctcatggaccggtatctcttatgagcttcttggatagaggcattggaaatgtcaataccaataaactgtgaaatacctgcagcaccatattttcttaaatcaccacctttgccacatccgagttctaaaacgacatctccaggttttgtatatttgtcaattaacatatacttaatcgcattgttaaaattacgaagcttaataataggcgatagattcctcttagcgcgattggcgattattgtacgttcattatagtgctctcggacaatctggtcaacatttatggatctatttgcagtcatctctatttcatgtctctttagttgctcttctctcaatttttgagcacgctgtttgcgtaatctttcctcttgatcatacctttcatgtcttctcttttggattttaaacccggattctgcctcaatgggtagatcagacaccttagaagtaaggatagagctgctttgcaaaactggtaatgatccattaccatcaccaggcgcattggcagtaactttggagtctttttttgagactgtggacgattcatcaccagtaattgagccgtactgacggtcatagtcttcttgtgacatccatattggcttctctggtttggttgacattctacttttctaagacggataatggacgactccacgttgtagtagttgtcacattaatcggaaaagtgtctcacatgtaaaggattaaaataagaaatcttctaatttatgttgaaatatcttgatttaccattacccggattagatgaaactaattaaagtcatttagagcaatggaccaaactaaaggtattagagttctttctaatataatacagcgccaaataattcgagaagggaaatcataacgctgttgccttgggtttatttgaggtatggaaactattgattcgaagcaaaatattaatagggagtctttattggaggaaaggaggaaaaaactagcaaaatggaaacaaaaaaaagcacaatttgatgctcagaaagagcatcaaacttcacgcaatgacattgttactaacagtttagaaggtaagcagactactgaaaagtttacggaaagacaggaacgtgtaaaagaagagcttcggaagagaaaaaatgaatttaggaaatctgacgaacctgtatcggttaagccttcgaagaaaaagtcgaagagaagtaaggtaaagaagaaaatatccttcgacttcagtgatgacgatgattctgaaataggagtttcttttagatcgaaggagcacattcaaaaagctccagagcatgataatgaaaaagatccactggatgagtttatgacgtcattgaaggaggagaaaatgagtaatagtaaaggcatgtacgacagaggcgacattcttgatgtagaggatcaattgtttgaacttggaggaaccgacgatgaggatgttgaagataatacggataattctaatatagcgaaaattgctaaactcaaagcaaaaaaacgtgtaaagcaaatttattactctccagaagagcttgagccgttccaaaaaaatttttatatagaatctgaaacagtttcctcgatgtcagagatggaagttgaggagcttagacttagtctggataatatcaaaataaagggaacaggttgccccaaaccagtcacaaagtggtctcaactgggactatcaacggacaccatggttttaattacagaaaagttgcactttggctccttaacgcctattcaatcccaggctcttcccgctattatgtcaggtcgtgatgttataggaatatcaaaaactggctccggcaagaccatctcctatcttttaccattgctaagacaagtaaaagctcaacggccattatcaaaacatgaaacagggcccatgggtttaattctggctccaactagagagctagctttacaaatacatgaagaagttactaaattcacagaagcagatacatccattagatcagtatgctgtacaggaggttctgaaatgaaaaagcagattactgatcttaaaagaggcactgagattgttgttgccacaccgggacgatttattgatatattaacactaaatgatgggaaattacttagtactaaaagaataacgttcgtagtaatggatgaggcagacaggctgttcgatttaggttttgaacctcaaataacgcaaatcatgaaaactgttcgaccggataaacagtgtgttctatttagtgcaacttttccgaacaaactacgcagttttgccgtaagagttttgcattccccaatatctattacgattaattcaaagggaatggttaatgaaaacgtaaaacaaaagtttagaatatgccattcagaagatgaaaaatttgacaatctggtgcagcttatccatgagcgcagtgaattttttgacgaggttcaaagtgaaaatgacggacagtcaagcgatgttgaagaagttgatgctaaagccattatatttgtatcaagtcagaatatttgcgacttcatttcaaaaaagctgttaaatgctggaattgtgacctgtgctattcatgcaggtaagccatatcaagaaaggcttatgaacttagaaaagttcaaacgagaaaagaacagtattcttctctgtacagaggttctctcaagaggtttaaatgttcccgaagtgtcgttggttattatctataacgccgtcaaaactttcgcgcaatatgttcatactactggaagaactgccagaggtagtcgctccggtactgctattactcttctattgcatgatgaactgtcaggtgcttatatcttgagcaaggcaatgcgcgatgaagaaataaaagctttagaccctctgcaagcaaaagaacttcaggaaatgagtgccaagtttgaatccggtatgaaaaagggtaagtttaggttgtcgaaagggttcggcggcaaaggactggaaaatatcaaaagtaaaagagaggaagctcaaaataaagatttggagctcaaaaagaatgataagaggagcgatgacttggaaaagaaaatcagcaatccacgcgaagggcatgacagtgtgtctgagtcttctgcgcttattccgagactcaattatgaactattcaaagagtctacagacgggtcgatcatcttttacgccaaggtttatattaatgatttaccccagattgtaagatgggaggctacaaagaatacaaccttattatttatcaagcatgaaaccggatgtagtattactaacaagggtaaattttaccctgaagggaaggaaccaaagaatgaaaacgatgagcctaaactatacttattgatcgaaggccaagatgagaaagacatacaattaagtatagaattgctggagcaaaaagttaaagagggggtcgtaaaggctgcaagcttgtctttgaagagtactaaatactagtttttagaatttaactcactcgtggtgctatatactttcgtagttagttctgaaatttttagggtggtaatttaaagcatattcaatcataataaaaaaaaaaaaagagaattattaggaaaaataaaaacaaaataatatataatatatgatgtagaaaaaaatcttgaaatttttatcgattcgaataaaatggaatttaaaaaagtgggaaagaaacaatgagaattcataggatataatgaaaggtaaatgctttaaaaaaaaattaagaggggaaaataaaagtagaaaagcaaataaaaacaaaacatggaataaaagtaacttcaaaaaaatttatcaagaaaatggtaggcttgaagaatataataatagttttttagttgatttgagatgtgatatgacaaataaaaaataatgaaataacgataaaaataaggaagggaaaaactgacaatcgaataataatattaataatggtaagtttatcacatcaattcatagggaatataaatttgaaattgttactcttctttctttttttgttctgtagagaaagaaggtgaaaagtgaaggatattaactttaaacacacgttggcttcaaattatgtaattcaggaataggaatatcgttaacgattaaagtttggaattggttcaaaacttcttgcaaaacggaatatttgacagcggtccctgttgttaatctggctagttgtctggaatcacggcaatatggagagtaacgtttaacaattttcaaatacaaaaccattctgccgtcaactggtatggaagaagaagcagcctccgcagcaaattcatcaaatgcaccagaagcagttgctgcttgcaatgctggatgagagtagaagtccattggattttgaggattgttgaacaaatgctctggtgctggagtatccattggagttaaggatggcgaaggagttgcggttctgcttatttgagtgctgttcatgttacttttcttggaatctctatcattttgggtccatgttacagtagcatctcttaaggccgcccaatctgcgttggcaataaatctttgaccaatttcatctgatttgcggattaaatccatccatctttggagaatttctgcattcgaagcatcatcgacagatcccatagactttaataagattctataagcgactattgtttttggaatgtggtacgcctcgtaactcttatcgatgtattctaaaatactgcggtcatgccagacagtgcatttagccaagataatgttaaagaaaggttcatctatatgcttgatgttgttgtaagtttgaataatattttgtaaagtttgaaaaccttgcatcttgtccacagcataattttcaaaaaaaatgtcgaaaaaagtgtcattcaaagatgaagaaataccgtggttgacgtttctaccataatgtaaagaagacttgtaccagatttgatagatgtggttgaaatcacgggtttggctccatatgtttcttaaaaaggatttcacgtaggaaacttgcaagtctatcttgtatggcatttcatcatttaaagccttgtcaaaaaaggtttgagccacattcaagtctttacattcaccaatgaaggaaagatgggtttctatcaaataaccgtatttcatttcggttgattcttggcataatttttggaataatttgagagccatgtcattttcactagcagataaagaggctctgatcatcccaactgaaagatttggatggaagtaattaatcatcgatgaagacttttcatatagagcttgaatttctggataagagacaccattgtcgtataagatgggtaatataacaccgacaactcttggattcagaaaaatattagatgtgtaggtattttgcccattgattgcagctttccatatgtcgacagcttcctcaaacaacaaaagctccttaaacgcagttatcaaatgcatagcaccgtattcgttcagttcgaccttgccgtttagaacgtcttcggagatctctctcaaagatttgcaaagatagtttgtcatttctttgtgaaaggattgagagtcgtaatcaggtttcttgttcattctcgtcaactgatttctattagctctcaacccattgtgaagtaaatgtacaagcttggagacacgatcagaatttaattccggtgtagtgagtagatcatgatacagccccattgctctacctatagaatcccaaaataatggattagcgttagaatttggatgttctgaatggtgtttcatgttttgacgccttggagtttgtgacatataaagagtctgtgaaacgcaatcttcgaaggcacaaaccttatgaaaccatggggagtctgggctaattgaattaccttgattggagttattatacttgctatgattatggttattttgatgatggttacgattgttattgtggtgatgattacggttattgttatgatggttgttactattattgctgttattctgagctagatgattgttgttgttggctccaatgttgccaccaaagtgaggaacaaaatggttggctgggcttacctgataagtagcgagggctggattgttaaaagtagcaggcgtgtaaggaatggcatagttgtgttcatggtgctccatagcgattgtaccgttaaatttcattggatgagtcagcgaattctttgtcggatgtggaacaaactggtttgggggtttgcccttcagtacttgtgtttgctgagctaaacggatcataggatcagatttgcaagatagaaaagcaattagagtaagaaatatcaagctaatcacacgtttttaaaacctcgatccaactatagaacgtactgtattcaagaaaaaaaactgagagaagaatgaaaggaaaagggtttctatagatataaccaatgcgatatgtaacttcagtgctgaacgacaaagtttctttattgccttattttgactttcttcgagatgtccatggcataacttgagcaaggttgaaaaaattttcttttctttttttctccgaaagaaacccgtttcttttggtgcacacacaaagctcgtgcagagtgctgtcctctgagaaattaccgcagaatcagaggatctatgaaattgcctctcttgtacgagcagttcactgcaggcactcgtcccttcacacggaaaaacaatatgggaaaagttgcctgaaagtttaagcttttttacatattatcaaggcaagaaaagaagagaaatttttcgagaaaatgaacaacgaagcaaacaatatgaagaggactgctgctatttttccagttaggtaccatgtggcatgctgtttttccgcagttcgttatgtaaggtggaaggcggtggtgtgtgagacatgccctgtgagacattggaaactcatgcgtacagaaagtgaaactagctcaattggttgagttttttgatggtatacgcctgatgtttttttcgacaacaggtgagtgaaataaaacgaagagcaaaaaaagaagaagaaatttaagaaaaaaaaaaaaaaaaagggaagaaaaacggagctacccaatatcggaagattcgtaaaggccgccatatacacaataggggcccttcgttatatgtgctcgagcctctggatatcgaccagaatgagcagacgcctacgaaactggtcaaggcttcaagtaaaattgctggaatctgttaacacttttaaaagaacacagttcttgacttacttttggtctatgcataggtattatataatacgaggtagtaaaatgagaaaaaaagaaaaaaaaagtcaattgagtatgggcatgaagttacccaagatcatgaggggcaaaccagagacatctctttttaatgtccacatacagcaacaatgaattatcttgcccttgatggggcttaagagcctgcaaactttcatcttctcagatcctctgaagtccctatatgcaactttagagagcgttttgaagtaatcgcgtacactttcatcgtccatgatctctacgataaaagtcatcttgtttagtagctcctctcttgtccatccgcatagaatttcaaattcctcgttgacataagaaatttgaccatttcttcgccaaatacatgtcggggtaccgatttgtgcaataaattttacatattctaatagagttctttggtagcattgctccataaaaatcatgtcctcctcggttaaagttacagaacacgcaatgaaaatgggccggaattcggcaatggaccgacacatcttcaccagatcctgctggttgaatcgatgctttaggtacaccaaaagatggtggaatccaggtgtatgcgaaaagggggcatttatggaggtgtatatttccattggagtagaataacgtaatgaatgttcccattctacattgctcttgatgttggcagcgtctggtgaacagctttccagggatacagagaccaaatggtttttcctccgctttaaggggatagccaactcgggaaatgttaccgtttcgctgttcaagtaatattggtttatgcttgagtcccaattaatttgggagctcttttcagatgggtcccgtggcaataatcttttaaagtttaaggaattatcagctgaatcaacgggcactaaggggaaatggttcgcgaaaagattaacttgcgaagctacaatcttggctgaatttggtcccagtagaatagaataaacgttttgattggaagatggatacggatgtgggggtatgtttgctcgctgttcgctgtacaactggcgaattttctccatttctgtttcttcagggcttgtatttgtgcccgtagggctattgttactgctattgcctattgtggagttggatgtggaattggtgttggagtacaggatgtcaatagggatcttgttagacaatgtgtcttgatagatgatattcgacagaatagagtactcggaatctgcagcattcgataggaatttagctttgtgaactatatgttgtgggctggtgaatttttgctgttctcccatgttatttacgttgaggctactattgctggagttgttataaatgggtatcatgatcttgcggggtggaaggtccggttgtatgttcattgggagctctctattcggtattccagccaagtacttgcttttctttcttggagcgtcaacgcatgtagccgtgaggcccttgctgatacatcgtaagcatggccttttggcctcacatgacacatgcaatctcgaacagttcacgcatgccacgtttgtgttttttctcttttttctcttctttttttcgagagtatgatttgtatttgcagatgtatctgggtcagttgatgttttgtaatcgttttcatctggagtgcacatcacgatgattcatcaatgtattttatttttataccttcgtgtgtctgttgtacccaaaagaaatgataaaaatagctcaagagtatcctgactttatataactagcaattttatctaagagagtaatgccgttgcaccggctcttgtttagtttttttatgtggttactcttttacaatatactaaaattgcaactcatttgcttttttcatttcttttccttcaatttttttttttttttagtctacggctaacaaaaagcataggctcagaatgatagatagatatccgataaatgtcagtaaagacaaagaaatcagtaaaataaacgtttcaccctggcagataggaaaccctatctcccagtgataaactttaattttttttcgtgcatatatatatatacatatataatataaaacaaaatatcatgaatttctatctaaagtagtgggaaaaaatatgtcgttaaaaatgggtataatatccaagcaaagcttttggctttttttttcttgaaatgagtgaagggaaggctcaataagcctagtcctgcatggcatatacatccttgtaaaattgttgattacacttcagttgtagctgccagtaccgcagttgggaacatgaaagtgtggtatcttgacatgagcaaagttgttgcaatattgtatctttccaactattcactaggcgctccgtgaccaagacatgtaactccgacgtaagctcgtcctggtagggatcctcgaataagtcggcattccctagcaatccattacaatggtacaggacgtctaaatcttgtgtattgtttatgataaagttgaccagcggatacatcgaaaatctcaatagcttttgctggagaaaccacactcttagaagctttgtcaagttggggcaggtatatccatgaatgatgaccagcattgttatagctatggattgccaatcgacacaactccaacgagcgatgcactctttgaacaggcacgaggccatattgatgtccgggtcgtcaattattttcccaaggaagcgtatgaattccgtggtcaacgagttcctcatcttattgatgaaccacgtcgtgtattcttgtcggttcaatatcatgttcccgtagcaattaaaccataggatcccgaaaattttgccttggataatatcgatcaaagaggtgctgtcttctggcggcgatgacagcgctgcagtagtggtttcctctgctgacgacatcgaatgacccggcgacggcagctgatctgtaagagcagaggtaactgcagccggattggccctgaaaactgagtaaggcccgtgtttggagcaattgaggttgaccacagatatgtcgttttccaccatattaagcaattcgtccaacttcttgtctatgcgcttttgagtataatctctatttgtcatgctaccaaagacagaggccacagcgttattgtatatcttcaatctccgtacgcttatggtgaatgtattatcgttaggaagcgtagtttccttacttgcctcgtgcacgctgtcttcgcagtcacttgtcgggggtgatagttgtctaaaatgggtcatttgtttaaaccttgattttgagattttctggcacaatggtttcgatttcgatttgcgagcctgtaatgaactgatcagtgaatgcttgcgtactttgtagatgttctcctctaaccacataagtctgatatcgtaactacaattatctccatgtttggcacacagtgaacagattggtctattctcgtcgcatctgcgtttcttgaatctgcatgcccagcacccagtaaatgtcctccccttggtggggggcactttggaggatgacgctactttcttgcttctctgctgcctcttactattgaccatttggttctagtgcggatatatatataggctatatatatacgtggtgaaatgaaatgaaaacgcttttaaagtgtgcagaaattgttatagctctaacccgtagtattagttccccatataattccgaccgagaaaggtgcacccacttgtcatacaaattgtacatatatatatatatatatatatatatatatatatatgtatatattatacctgcaagcaattgcacgcgagtactctgcgtgagtcaaaagactgtggtaaaatggtacccatctgatgcaggaattccgactctttcaagctaaatgccgtttcattttggcacggatgcattcgcagattggttggaaatccgcatacatcaaatgcgccaagagggctgccattgtatattccttttctcggcagtcctgccggatgcatttatgccgctaagacgcagaaccgaatattgggctcaggaaaatatgcagatagacgctcgcccgtgagcgactcatgacgcgcgtgtgctattttggccccggcagtacaagcggtagtcatggtttccgccacacggatctcatacaacagcaatccatttggtttgcctagttccgtacatatacatagatactaactaaatgagtgcatatactcatgtagccgttcgttactagaagaagaagaaaataaaaaacagatgaatagctagaaagaagtaaaaaatagttgcttaggtatatatgactggctacagatcagtagccagcccaaacctcgctgtatgtagtcttgccctttgtctcgggtacacgcttgtacacatatgtagcaaacatggcagcgatggcggcgaagatcgcaaatacgtagccgcccatgaggccgtggcctatcgggaagaggtatccgacgatgaaggtggcaagccagttgcacacagtaccaaaactttgagctgtagcggcatcctgcgggtaggatagctcaccaatgatcaagaaggggatgggtcccagaccgatggcgaatgcggcaatatagacaaaagtggccgtgaccagtaaaaaggatacgctcaaggtgagacctacactgatcagcagcgacatggcggtcatcaccgtagtcgaggcaagcaataatggacggcgcccgacgtggtcgatgatcgcagatgctgctagagtgacaacgacattgaggatggaaatggcaaaatttacctgaatcgagtagtccggtagaatcttgccgatcacttttacaccgtagaagataatagagttgatgccgcaaaattgctggcacgacaagatggcgagtataactgtgcgcggtttcttgtatgagggatcggtaacatattgccatagtgtgggtcctgaatgagtctcttcgcttgactccgggtcgcggttgtgcccatggctacgctgccaatcctgaatttcttgcttcgcttgttggtacgttcctggacgcaacttgaacagagcagtttcagcttccgagacgaatccgtggctcaccagccaccttggagattcgtccactttgagccaagctaaaatattcgctaccgcaatcacggatccggaaaagagaagccacctccagttataggagtctgcgtacttgagtgccaaggtttgggtcagcaggatacctagattgatagaaacctgattcatagatcccatagcgcctctccactccacgggggcaatctcgttgataaataagggtgtgatcacaatggcggtgccgcaggacatgcctaccaggaacctgccaaatagcaactgcaagtaggagttggaaaagaaaagcagcagagaagaaaccatgcacatggccgaggcgcccatgctcacgtactttcttccgtatcggttggcccagttaccggcgtagtacgacccaaacagtccgcctatgctgaatatagacgtaattgcgccgtattgagaatcggttaacgcaatgcattgcttgagtccgtgttgcccaacccaagtgtcatcgtatgagatgttttcgtctggtgcctcaaatctggagcacgataagaattcttgaggcgcattcaactctgcgatgtggtatccgtactggatcgaccccaaacaagcaactatcgtgcccaagattaaatggcccgtaattaacggttttgtttcgcgggaaccaccgttaggcattagtctttcagtttcagccatgacttagtttgttatgccttagtctctgtgttttgttgttgttccaagagagaaagatattcagcaacttttgttctcctgttattcccttaatcaggaagcaactttaagggaaatccatttcatccctcacacttcccatcttttctcggacaaccttacattacgcctacgacgtatgactacacaagcaagttcgttttacagaccgcgtatcattgctcgttacagctctaccaaaagtgtaccgagcactgtgcccagaagctaagcttttttcgctaacatatatatatatttaggtaaatcatttacacttttcgtcgatctaaaagctcatcgcattttttcggtcctgatgttaaaaatttatttcgtttattaaaaaaaaaaaaaacattactgaaacgtataaaagaaaagtcttaatctataaatatggttttatcataattagactgttttactctgtccattggtcattataaagcctgaaaatacccactgaatggtttttttcgcaggagcaaaccttttccatttctaataaaccttctgcactatttttattctcataaaaaacaattgtcaaagaaagcctacataaaaaaaatatgacagcaacgatcacaaataagaaatcatgctctggttctgttgaggcaggaaagacacgtttaacaactgaatggaagcctgaaagccaagtaccccaatatgttaaaaatgagctctctaaaccccatccaaactatatcctggcgtttttgaacgtggtacagcaattaaaaattcagagaagaaccggttatcttgacctcggtattaaagaatgtgaaagcatatcagatcacatgtacagattgagcataatcaccatgctgatcaaggattcgcgggttaaccgcgataaatgtgtccggatcgcattggtgcacgatatcgccgaatctttagttggcgatattactccagttgaccctattgggaaggaagaaaagcatcgtcgggaatgggaaaccataaaatatctatgtaatgctctgatcaagccatacaatgagatcgcggcaaaggaaattatggacgattggttggcttatgaaaatgtcacctcattggaagctagatacgtgaaagatatcgataaatatgaaatgcttgtacaatgttttgagtacgagagggaatacaaaggaacgaaaaacttcgatgatttctttggggctgtagctagcataaaaacagacgaagtaaagggctggacaagtgaccttgtcgtgcagcgccaaaaatacttcgccgatttgactcaatcgataactaaataattatcataaataccaacttttgcgtcataaaagtacaaagtaactaccaatacataatcttcaacgtactgtccataggttgtcgtggccaaagatgatagcgcctatagcgtgtcttccaagtaaagccaaaattccaatgcagaattgcaacttcaagattgtattgcacaatttgtcttccctcatagggccaaaccatactaatgtcaagtttattaacgtcatattagaggtgctaataatctcattattttcatcaaattccaggtcaatcaaatggagacagtatagtaacttcaagatcggtttaaaaatgctctttggcggttcttcttttaagtttgctcttgatggatacattaaaccgtctttttcattaaatttaggtaacctatgtctcgggcaggggaccaatttgaatagctgaggacatgaataaataaaattaacgatttgaggaatgaatagcaaaagcatcgtctttgaaaaatgacccagtataccaacgactgcgaataccattccagcgaaataacaatatgtatctcccacaaacactgtggcgggccaacgattccatttccatagcgccaaggatacacccaaaaatgggataatcaaaacagcggaaaacctatgggagtctcttgtggctaatggccccatcgagaagtacagcaaatcgttcaatagcgctaagatggccaacactatacattggccaacctctaaaccattaacacctgccaggatgttgatggagttggggcaaaaaattgccatcgatgccatataaacataataccacagccccaaatcaacactagtctttttcaaccagcgttccatgaatccgggaataagtacatgcgtaactccaaaatccacataataaaccattagcagtgggatggctgcaatggcaggcaagaaaaacttatgtctccaacgtaaatcaaataaatcatcagcgatacccaagaggaccgtactttccaagcataggatagcgctcaaatattcagatagtttatcatgaggaaaaatattagaattcataccgttatcttcaaccactgagacatcgcgatggcccccacctgaagtggttatgaccatatacttgtagaaaatgaagggaatgtaaatgaacattacaaataaataaactgcagcagggatagcacctattgtttctggaagcaccggacggccaggtttactcaagtccttaccgaataggcctattttgatgaaggatttgcccacacgtggaatcaacatatctgtagctaaatagcctgctataccaaatcccacggccgcaacaagagcagatgggccctgatttttggaatagtagattaagcatgtgataagtgccagtgaaaaaagtcgcaacatatagtctactttttgttaccgttctccgccttgctctacttgataaagtttttatttacatatttcacagttatatacacatgttaacaatttaattttcgcgctgtttagtaaagcatttttcgagattgaggcaatataaaaggaaagggccatatacaggagatgaaggaaacctgtactattattgtattaaacacatggtagtagctagaaaaaattcatgcatcaacctctgtgtttgtattcgtaacatataaatccacaagaaattttttactcatcatccgctaaaaaaaggaaaatacggacgttacttactaaatgtacgacgaacatgtacacaaatcttgactatttttgatagatgcagtctcttgaaatgaccaacgactcagtagtgttttccaagcaattttactttcaactgtttaatattttttagaggctactcggccggccatatctagacaattagtaattccgatgacaaagagtttaaaaccacaatatctgccacacatatcgtgaaaggcattagttccattgtctccgtattagtgcaaagcccctaagccagcctgctttaaaaaatgtgcaggtacttttgttattgttttgatatataaagaactactatttgctaatatgtgatgtagcgcagagaacttgcatttccctgcatggctgaccttgacaagaatacaattagcaacaaaaagtaataattcaaaatgaccacatctttttatgatttagaatgcaaggacaagaaaggcgaatcttttaagtttgaccaactgaaaggcaaagtagttctcatagttaatgttgcctccaagtgcggcttcacgccgcagtataaagaattggaagaactatacaaaaaatatcaagataaggggtttgttattttggggttcccatgtaatcagttcgggaagcaggaaccgggctctgatgaacaaattacggaattttgccagttgaattatggcgttacattcccaattatgaagaagattgatgttaacggaagtaatgctgactctgtctataattatttgaaaagccaaaaagcaggtttactaggtttcaagggtatcaaatggaattttgaaaagttcttagttgattccaatggtaaggttgtccaaagattttcctccttaacaaaaccatcgtccttggaccaagaaatccaaagcctgttaagtaaatgatatctttgtctataatcaagcaattatccggaacaataaataatacatttatagattagtatgattatatatttttcttcagaagcatggtgtaggatatattaaaaaaaatcgaaatataaaaaaagaaggtttaatgagtggtttcgttttccggaattttctctgctaccaactgttcagttccaacattcgacgtatcctcaatcttcgcttttttgctctctactccatcaacgttctccttctcattagcggtctgatctgcaaattcttcccttatccttttaccattttcatcttctttcttcattctatctttagtggcgtcatccaatacaatccctgcgttaaattccttttccaagcattgcagtaatgtatttcctcttctggctagctctacaggtgtcctgcttctgaagtaaaagtctaattcgaataggggacaatctctaatttcatcacgcactaattcgtatacgtcatctctatccaagccatacttgaataacatgagaaggataaaacgatcttcttcttcagagtacgtccttttgttgttagaagaaggaggatgttttaatttcaaatcgaagaatggattcttatactcagacaacttccgacgtaaagcctcttgttgcattttgacacgcttgatcttctcttcttcattctcaattattttcagatatttctcataatcttcaattctttcaatgttagaccagaaggccttagcatatgcgcgaacttcctctagtgttttgccaggggccaattctctcgcaatggcttgaatggagttcctaccgtatttaccagataccgtgatgaattttctaaattctaatttattccaatttgtaaatccttcagactcccaatcagccttcatcttttcttcctcttcagttaatggttgcgagttgttaaccgacaattttaacaattccaatttttgtttcttttcttcttcatctgaaatatcgccatatgctgcttttacgtcatccatggtcggtacataaccagtcttcttcgccgtccacattctttccttttcgtacaggactttcaattggggaggttgtaattgatgggaatggaagacatgaggcttaggcattctggggtgtgatggggtcgaggaccttcctgtattcaaaacatctttataataattatcaatagagtaattttccttacgttcacgtttggtggggttgagcagtagcggacttataatatccctttgtattttcttcttgaaatcttgaccattccattcataggccgaatcttggttgaatttttgcaaatcatcaagacctaaagtttcatattttgcatttaatgacttagttttgttttctgatttcagtaaaagttcgtccagatcaatatcatctcctttttctcctgaaccaggttccggcgtaccagctgaaccggtagatgtaccacttttgaatacatcggcggcaccatgttgaatcatggataataaagcatctttggaatctgctttattttccttctttttcaaagaagtcctgttttgctggataactaattgatctaatcttaacttctgggtagccctttctaaaattttctcttccacggagttatctgtgaccaaacggaataccttgacctgcttcttctgaccaatacgatgcgctctatccattgcttgtaaatctgcttgtgggttccaatctgaatcatacaagacaacgacatctgctgacgttaaattgatacctaacccacctgcacgtgtcgttaataagaaaacaaacttcttagaatcaggagcattataatcatcaatggcttgaattctatcttcgtgagcggtggaaccgtcgatcctgcaatattcatagtttctgaagtagcaataatcctcgagaatatccaataatcttgacatttgactgaaaatcagaactctagaaccttcttccttcaatttcttcaataacttatccaaaacttgaagtttggcagcgttataaaccaagtgctcatccgtagtgtacggtggacctggctcagcaccatcgaataaatatggatgattacaacattttctaagttgcatcatgatatttaaaagtcttgttttggattccttgctgccattagacccgttcacagcgtccagatccttttccaaaatctttttgtaccatttcttctgcatgctagacataccgacatataaattcagttcctttttaggcagtaaggatgtttccacatcgcttttgatacgacgtagtagaaaaggctgtaaaacagtgtggagttgcttgacaattttatcctgatcttcctctgtgctttcagaagaaaaccaatcgtcgaaatcttgtgcatcggaaaagatatctggtaacaaaaaatttaataacgcccatagttcatgcaaattgttttgcaaaggagtaccagtaatcaacagcctattacgtgaggtaaattcccttaagacttgcgaaagcattgactcttcattcttgattctgtgagcctcatcaatgataatatactcccagttaatcttcttaaggggcgacttttctcttataataatttcataagaagcaatcacaacatcaaagtcacaacctaaaagttttttttggatcagttcagctctttcttctttatctccttgcaaaataaaggcgtttacgtctggcgtccatctatttatttctctcagccaattatttaaggtagacttaggcgcaatgactaaaaatggacctggaattttttcaatgtacctaagatatcccagaaatgaaatagtttgcagggtcttacctaaacccatttcatcagcaaggatacccgctattttgttcttatgcagagacaccaaccagttgacaccttggatttgataaggtctcaattgaccattaacgtaagcaggtgattctctgaattggaattcaatgctctcatcatcatccgagtcttcttctttcaataattccgcatcttcttcgtgttcagtctttcgtctacgaacatcttggtgtttgcctttgcctttgccatttgctttattttcttctaatacatctaagacctgcctgaatttgggatctttagcggctttactttcaataaaatgcttgaataaaccactcaaggatagcagatgttcaaatctttttgtagtgccttccagatcaaactttttaccattagcatccttcagcaggtaacgttttttattcgattcaggatcatgtggagggagaccgacctggaacggttttaaattctccaagtactcttctgaagcagtcataattgaaccagatgaaatacaatcgtatttttttttttcttgcaaaaatatggcgagaataattttgaataggttctcatctttgtccttttcattgcaagaattgttttcgtgtttttttctcattctagtatagaacttgaaaaagtgaaaatttgcaatagctaacatataggccataatagggtatttctacatccacctctagctggtttttgcatagctatacatatggactctattcaagaatcagatgtactaaatgcagtgaaaacaaaactaccgccgtgttgtttgagaatattcaggaataagatcatccttgttgggacgtatgatttagataagtcaactggatacaggtcaggctcactggatgtcttcacaatggacctcaaacttttatgttcgaataatacgtatggcgcaatcctagatttgaagttatccccctttgatgatacattgatatgcacggcccattcgacaggtaatatcatgctatggaggatacggtgcacagataaggatgatttccaatcaaacgaactagatattcatgcaattgcaaatctacaactctttgaaaaagatgttctcattgcctcgtgccatttttccccacttgattgtaagaaattacttgtaacaaatacggcaggcgaagcagctaccattgatataagaacactatctgtacagttcacggcatcagcaatcgcgcaggcttactcaaaactagataaaatagattacgaagttcaaggtgcaaccgaaaaagtcattcatgttgaatcgggacaatttttgaaaccccatgaactcgagtgttggactgcggaatttggatctctacagccttttcaagacgttgtatttacaggaggtgatgattcgagaattatggcccacgacttacgttccaaagaattcatttggagtaataatcgtattcatgatgctggtgttgttagcattaagtgtagtcaacctaactttcgaaataataaacccacgtccataataactggatcctatgatgataacattcgttctctggatttaaggatgatgggtgagtccatatttcctggtgcaaatgtccccacagttaataaattggcgtgtgatcttggtggcggtgtttggagatttgttgaatcccccattgatcaggaacaatctcaccacaacggctccgatcggcttttagtttgttgcatgtacaatggtgccaaggtggtgaccatgaatgataattccgatgagtattttcaaattcaacattatctgaagaagggccatgattcgatgtgttacggtggcgactggtcaaattctttgatcgcaacatgctcattttatgataattccttgcaaacatggatagtttagaaaaaaaaattcagtctgcaatatatggactaatatataggctaatatataggctaatatataggctaatatataggccatattttgatgatttcgatagattatgcataaagaattgataggaaggaacttgcctgaacaataatcttttactctatattttctacttattatacatgattcagaagctttgttgaaagggggaaagaccgagcgatataaaattgatgaaaaattgatattacagcatcaattgacatcaatcattaaatcatcattagcttcctgtggatcaacaaactccctgctggctcctgccaatagttctcttctaatctcaggaccgatatctttatggcctctttgacgaacagtttccaacaagaaatctctctgatcctgggtaatatcgttcttgtaacgttgtgcaaatgttaagaaagccttgtgccatatcactgggagtactcttgtagcatcttccccattactaccgtcatccaaaattctaaacctcataaagtaatacacgcagtcgtccaccgtctggtacggtaaagcatattttttatcgagcaatattttgataaaaacagttgtaggtggagagaaaggtagccttaaaagataactcaaggcagctgaagaatgtaaagccggaacagagactttagcaagcacacttcctgcaattgtcgcttcacgtacattacaccctgtttcaaccaatgggaataggaaacctttgaagaaggcacttggtttataaagcgattttttcaccgcacggtatatatgatagtttaaagagtggtcttcactggtctcgatattgtcacggaaacgttcaagtaaaattaggttaataaatttttgagattctttagcagttaggttggatacaaataatttcgttgcttcgtaaacaacgtgtggtgaccattcttccgggttggtcacataaatgacatcttgccaatttcttaaggatgggataaccttgaacaactttggcaacttaccgtgcgtccaagtttttaaaatactacctaccgtagtatatgctttgatgaccttctctggaagtgcaacaccctctccactcttcaaaccggatgaaatattgcctcttgaggtattctgttcattagcaagtggttcatcatcttgcatatcttcaacttgactttccttttctcggatagaggccataatcttgtctgcaagattatagctaccacttaaagagttaaaatcatctgatttcttgaaatattgctcaaacatcgctgcgtcttcttcatcgatttcaactatctcttcctcttctttataatcaccttcgggttcaaaatcggagatgtcttctccaaaagcttcttcgtcttcgtcttcgtcttcgtcttcatcatcatagctcatggtggtgaatctggcttcaaattgcttgtttctttctgattcagcaagttcctcaccttcaatttcatcctgttgttccttggccaactgcaaaatttttcttgatgctttggagtctatgtatccatcttcctcatttgcagcatcgtgatttgcagcatcgttctgcgctagcttctttttattgatttttttcaaggtaccttgagctgcatctaaatcctttaaaagtggatcatgcctctgttttctggctttagtagaggatgctctggccattatagttaatctttctaatatattgttttatctgtaagtcttaaaacgagacaaatcttggatttaaaacaacttagtgcatatttcctttcgtcaatgttgaagaagtgggagctcatcgatttttaaaaattttcatttccgatgcctcgctaaaaaaaaaaaatgaaaaagtggaaaaatatgttctatttcttcccctactgacaccaccaataatacaaccatataagttggtacaatttctccaagctgtacatcctcttgtgttgtgaaatgtctgatttaacatctatcattattgcgtatatagactgagtcaagattataaagtatacatatccaaccacattactcttcatccattctaacctttaatccgtgctctagtaaatactcctttacatcgttaacagtgaattcacctctgtggaacatacctgcacccaagcaagcatctgcgcgggtctttaggaaggcctcttcgaaatgttcgggtacaccggcgccactggatgcaatgacgggaatcttgaccgcatctttaacatgttctatcaattccagatcataaccagaattagagccatccttgtctatgcagttcaataaaatctccccagcacctagagcttcacatgcccttgttaattcccacacaccaaggtctctagattctcttccacctttgattgtacattggtaccagcagtatttctctccattggggcccggatattctgtctcgaagactttgttcttcgtatctgcttgtgaatttacatatactctcttagggtcgacagaaataacaactgcctgagcaccgtatgctttcgagattgtctctattggtgacgttccatctcctctgttacccaactcgtagtatttttcggctgcatagactgcatccgtaccgatcgatactttatcagcaccagatctgaagtatagacttgcaacttctaaagcaggtattttggttccatcaacatcgacaatatccttgatccccccaccgactgtcaatggaacaaagactgtctttgcggcttgtttcagaacctctagcatcggagtatccttcaaaggacaatctctaaaagaagttatattcaaaaatgttacttcatccgcaccctgttggtaatatttctgtgccaactgaacaggcttaccaaggtttctaacacctttaccatcacttttttcacgtacatcgtattgatcacctttagtaaccaccaaatcaccttggtcattagtacgtacatcaagacaagcaataattctgcgtgttagaccataatttgaatagtcattcattaagagttccttctcttccgcactatagtttggaatcggaggactttgttgcttcaaaaaattctcaatgacgttcaaaccagctttacctgatttttcaggatggaactgagtagcgaatatattattcttgttgactgccgcaataaattcctctgaaccgtacttagcttttgcaattttccaaccgtcattttctaggttttttttcttttctgaattcagaatggcagcaaaagaatggacgaaatagtacctcttgtatggatccaatccaaagaataggttttccgagggaatgcaagaattccaacctatttctggtactggcttttctgaatcatcgaacctggacaacttaaaatcaatgtagttcagacccgtactcttagggctttccacggaaccggcaaagagcgcttgtagcccgacgcaaattcccattattggttttccagattcaatgtattctcttatcggcttttcgaatcctctattaaataaattgtcgacgaaatggccataatttccgacaccaggcaaaatcaatcttgacgtgcctgatatgttaaaatcctttggtgatttcaccagttgtacttcgtaacctaaatgctcaattgcattggttagtgactgtaggttaccactttcaacgtcaatcacgtgaacgaccggcattctctttttctttacttgtaaataattaaaaaacctaaactggatactgctacttcaatagctgcctcttttcttttaaaacctgattgagtagtcgtcgatatcaaaggaatatcaacttatgtatgtttcgatgtctgactcttttctcatgaatttttcattttttcatgatcacctaattagccgtggagagagagaaaaataatcccaaagctacgatatgactcaatttttttttgcagaagagtaactgatagtataacatccacgaaatcagtgaaaggtcagcgagctttgcctttaaaaattgagtttctagttaattagtaaatagcgctaaacacaattaaataataccgaattggcagtggtagaggaaagaatgtacgttacatatatcattaaaaaaacatctatttcttgttaacttctcttctttgtctgacagcagcagccaatttcctcaagacgtcttcagtagtttcccaacctatacaagcatcagtgatggaaacaccatatttcaagccggctttaccttcggctgggatgccttggttaccttcgttgatgtttgattcaatcatgacaccggtaatggcgttttcaccgttagcgatttgctcacaaacaacgtcattgacctttggttggtttctgaaatccttattggagttaccgtgagagtagtcaatcattagaccgttggaaccggcaggcaattgagccttagcttctgcaacggacttagcgtcgtagttggtaccctttttaccacctcttagaataacgaagcagtgttcgttacccttagtagtggtgatagcagcaacaccatgcttagtaacacccatgaaatggtgagaatgagcagcggcttgacaagcatccacagcaacatttaaggtaccatcggtaccgttcttgaaaccaactgggaaagacaaaccggaggccaattctctgtgcagttgagattcggtggttctggcaccaatggcaccgaaggagaccaaatcagccaagtattgaggagaaatggtatcaagcatttcagaaccaattggcaaaccgatatttgtcaagttgacaaacaattgtctagcggattgcaaacccttgttgatgttgaaagtgttgttaacatcagggtcattaattagacctttccagccgacggttgttcttggcttctccaagtatgctctcataatgatggataaatcaccttttaattcatctgacaatttctttaatctcaaagcgtattcttgagcggcttctagatcatggatggaacaaggaccgacaatgacaagaactctgtcgtctttaccggtaataatatctatagcttctcttctacctctcttggcagtttccaaagaagttggtgtggctgggatttgcacttgaaggagagctggagaagctaatgggtcgtaacctaaaattctgacatcttcttcagcaccttgatttacctttggcatgccgttggcagcgaacattggagattcactcatttctgatagattcttttgtttactaaatttagcggttaaatatataaaataaacgaatataaagagagactcttctagttattcttaattactcttataacgatgctaaaaatgacgaaagaggaattaacacgatatatagataatataccaatgaaaagaagaagaaagtatgagaaaaagtttctgtattaatatgaaattaaacattgattggattcgatcacgatgtattcaatgagctaacaatgcgtcccgcacatctttttttcaaaatttcaagcaaaattttttcatttcatcgttgagtcatttcgcagtaacgtacaaaatgcacagggtgcagcgggtggggccacgttttaaagtgattctgccatgcctttgcctttatattaagcaacataactgcctgacagtaatgcaactacacagtgttccgtgagaccgttacagcttatgtttacacagcctcatgcccaatgaaagagtgtcaatataaggaatgcgcttgcatatatacgagtacataatttgctgttgatcacgtgattcataatttttttatttatgtgccgatgacaatgttttccatcactttcaaggctagctgtatactggcagttcgtgttcaaaaacctgtgtggagttttaccctagcattcagttatgtcagaagtgtgtttggcatctatgttaggccaattgttattgttttatgcgaattatgtgggttgtgcagctggggtcaaaaagagcgaatgtaattatattgtaaacattaaatctgcacaatggaatcttgtttagcctttgtttttttctttttctttctatttcttttgttttcgattttgtttttgtgtcacaaaataactaatggcgacatcgcagttttttgggcggctgcatactgtttaataaaaagaagttactgctacctcaagatttcttcctaagcactcaagcccatgtttgccagtattgttatcttgcaacaaaatcagacaaatagaatttcccttttttgtttgactaatgttgttttcgtcttcatcttcttcacttaattccgaggtttcacaagtgttctcggaaaatatatctagtagatccactactctgactgaaagttccacacaaagcgagataaggcagcattttggtaatgaagatttcagtggtgaactaccaaaaaaattaattcaactcaagaaattaaaaaatggtggcactacaatcaagaaggctaaggaagaccttgagtattgctatgattcactacggctgtacgaaaatccctatgtaacatcatctgtagataaaaaatgtggttacagcattgaattgtatctagataacaagtacaaaacactaatgttctccgatttacaattgaatgctgactatccgttgtattacgattcctcactggataatatatctacaaatgttgaaagagaaagagccactcctctacaaatcaaaggaaagattaggataaacattgatagagaagaccaggccctcttaatcacttcccattcaatttctttaaaatgtttcacaaaggaatatgcatgctttgtaaattcagaaactagcaaaaactcctatagtgacaaaattatcaaagaacttaatcacacagagttttttgagtcttccacctaccccaaacagcagttgagagtcatacaccactcattaaatgataagaaaattctattgacaaagggcacgtacgattacccattcacttttacccttcaagcaaatactttcccagcaagtttctcttccttctttggcaagacccattttcgaatagaaagcttaacaacaataatgagaataccaagtaaacctaaaaacttactcaaatttttgaagaatgaaagttttacagataagatcattttaacagaagaaattaaagttaaaagagtcctgccttcaacgagtatgcttaagtttgaaacatttcaattaaggtcatacaatactgcaagtgagatcgtagtatcggtcattggaaactccaagttgattgaaattggtatgcctttccaaatgatattatcaattaccaaaacagattcttccattgaattacaggaagcttctttggcagttgcacagagaatggcaataccaagtattgatttgaagaccaagaaaatactacgagagccatacattaaaaagtccgagtatttactaagaactgtagaaagccaaagtttcgattccgacaagaccattttcggattttgctttgatgacgttgtcatcccaacctatgcggatggtctaccgagctggtttaaaacattctactgtgaaccaagttcattttatcccaatcatgctgccctcaaagtaactcatttgcttttgttcagaataacctatagcaggaatgaattggtggaagggcttgaaatgaaaaaaaattatcgtattacggtgaattttccaattttagttggcgatagtgatatttcgaccagctctttgttacccaaatatgaaaaatttgaaaatattagtgatctacaagatgaacccccactatattctatggtagcaggtgagaatagcttatgaatgttcggtacctcagaacaacgcctctattttatcctttttttttttatttgcatgatatacatatactattttttattagtttcttattctactatgtatttacgtaacaataaatttacaggtctctctttttgtaagtatcttgcacgctgatatctataatactacttcacaagttgatcagcttccgagatagacattttatgtatcaagtcgccatgtccgttctctactggccggtgtatattatgatatttcgaccggttctaatacataagcaccgcccactctgaggagaagacatttttacaagaattactagccatattttcccttgtcaaattagagaaggaaaaattacttgaaacatcccgtgtttgggcactaaaagtatatcaataggagctgaagaacactacactagactctcttggcgtgaaggccttattatgtgaactttcgtaggtttgacttttactaccagtatgaaaaaggttagagtttattcaatcaaatggaaaagttttacaactgagctagtgatctccaaatgaggtagcaagtaacagtcgtatgtatcccatacatttatgtatcccatatatttcattacatggtgatgctttcttttattcgcggagtaaagttccttaaagtgaaaaaaaaaaaaagacgaattgacaagacaataatacaagcaccactaaaagacctatcgttattgttgtcaaagtagacggtaaaccatacaagaaacagatttcatagatcaataggtaaagatgttcaagaggcaattatcgactagtgttcgttatctacagcattatgatgagtcgctattatcaaggtactatcctgaaagtcttttaaaatccataaaacttgctcaacaaacgataccagaagatactaaattcagagtatctcgtaacgtggaattcgcaccaccatatttggatgattttaccaaaatacatcctttttgggattacaaaccaggcatgccccatctccacgctcaagaggagaataataacttcagcatctttagatgggaccaggtacaacaaccattaccaggcgaaggtaacattctgcctccaggagtcagcttaccaaacgatggtggtcggaaatcgaaaagcgccgatgtagctgcagggctacacaagcaaaccggtgtagatccggattatatcactagaaagttgactatgaagccgctggtgatgaaaagagtgtcaaatcagactgggaagggtaaaattgcgtctttctatgccttggttgtcgttggtgacaaaaacggtatggtaggtttgggagaaggtaaatctcgtgaagaaatgtccaaagcgatctttaaagctcattgggatgcggtaaggaacctgaaggaaatacctaggtatgaaaacagaactatttatggtgatatagattttaggtatcatggtgtgaaactacatttaagaagtgcaaaaccagggtttggattacgtgtaaaccatgtaatctttgagatttgtgaatgtgcaggtatcaaagatctgagtgggaaagtatataaatccagaaacgatatgaatatagctaaaggtaccatcgaggctttcacgaaagctcaaaagacattggatgaggttgccctgggtagaggcaaaaagcttgttgatgtcaggaaagtttactattcaagctgaaatactatgtacatacacacgcaccattatctctcgttttacataagtaaatacagcaataataatacctgtaaatatctcaacatactcaatcaaatgagctgataagcatattcaatttttcttcatagcaatatttttttctgtccaagttttattttttttccataatttctgatttactaccattgaaaattataaaaggaaaaatattacgcgctaccatttaataagtagaaacaactaagttctcgaatgagatgtttgcactgatacagcgagccaaaaaataaccaaatgactgctactagcgacaaagtactaaagattcaattgcgctcagcaagcgctactgtacctaccaaaggttctgccactgccgcgggatacgacatttatgcatctcaggatattaccattccggctatgggtcaaggtatggtttccaccgacatatcgttcaccgtacctgttggtacctacggtcgtattgcgccaaggtcaggcctggcagtgaaaaacggtatccaaaccggtgctggtgttgtcgacagagattacaccggtgaagttaaagtagttttattcaatcattcacagagggatttcgcgatcaaaaaaggtgatcgcgtagcccaattgattctggaaaaaattgtcgatgatgcccagatcgttgttgtagactctctggaagaaagtgcaagaggggccggtggctttggtagcactggtaactaacttagtgtatatactttggcacacttgtataatgtataataaaatcaggataaatccagtgtgacccggactgaattactgaaactttgaagtgttaaggaaattgtactgccatttaacgcatttacctatcacttagtagcatgcataagccatgggctaatcataacagattgtgatgataggcatcctgtactccttttttttacaagaaaatgagcaaccaggcactatatgagaaactcgaacaaaccaggacgattctgtccgtgaagctggcggaattgataaatatgactacgatagccgatagaaatgatgatgacgagggttcattcgcacaagaaaattctgagctcgctgtggccacgaccagtgtgatgatggtgaataaccagaccatgcaattgattaaaaatgttcaagacttgttgatcctgaccagatcgataaaagagaaatggctactgaaccaaattcctgtaacggaacactcaaaagtgactcgttttgacgagaagcagatagaggaattactggataactgtatagaaacgttcgtggcggaaaaaactacgtaaaaaggcggtatttatctattatttggccaaaaaaaaaaaaaaatacatactacatatacatatacgccataaaaaatctctgcatctatcttatttcccattatttggacaaatgcttacgtgctaatgtccttaccctcgagtcgaatgccgggctcctaatagggtctgtaatcttataaaacgggttcattagtgtctttacgtatagttcgtgtacctcttggtagaatgacctcatattattgtcgtcaataactacgctactgttggctgagttcccatggatcatcacgaacttcatcccactatagctaatataagccgttattgctagtccataaaaatgatcaactttacctagataacaattatcagtattgtttacagctctagatcgaaggaacccaccaccgccattggatccgtttccaccgttcccatttaactgtgaagtcggattaatttgccattgtaaatcttctacgatatctagtgatgcatgcagtatgaacggatttaattcttttaaatcctgaggaaaaccctgtggattttctgcattggtaaactcgatttcatagacaggattgtccttcttaccaataatggcaaaatactgaggcatctcaatgtgctttgtatgttttttctgtattctctattcgtattagtgtttaccttctcttttttttcttgatacagattgatattatttgaaaaaatctgatgagtaaggctttgaagaggtaaaggggatatcaagataaaaaatatacacttcagcagaggagggggaggtactttaaacggatgaaacatgactcatacaaatgagcacgaccataaggctgaacaacaacaaaatggaaggggcgatacaacaacagagactgtaaaccctcagaagatgaaattggttaccaaacttctcattgataataaatttggactaatggacgacttgaattttagtataccattaaccgcttcttctgagggtgtaccaatatcagcaaagacatcagaattgggtacggagtacctcaagaatcaacaagagaattcagtaagcccaatacttccaatatcaagaagtacaagaataaaagcagacagggtgagaatatatttagactattattataatatattagagcgttgcatttcaattgatagctcccagaatcatcatgagggtgttgaaggggtgtacaacccattacaagttattaggaatcgtaaattaaaaaagaagcatcatgaattacctaccagagagttttatactacaaaacaccctattattgccattaagcagttttcgaaaaaacccaacaaaaaaatgccgtggtttgtagatataaacgagaagtatatggatttgacttggagaacttcgcattgggaagaattagtggatcctcaaggtaagctttggttccagtcttatagtccttccaacgaatcgagcggatcatcatcatcccgccggcatcatggacaccacattcatcccagaagacatttacaacatcactccagggtccgtacagctaattcagtgcactcaaacactcaatcactgacaccgaaacgagtcatgaccaatgaagaagacaataataatcataacaataataacatgataacgaagatcgcaactactccagaagctcagatttcaaggaacaaaaaatctgatctcaatttaagtcacattcatttagaggtaccaataaccaatacagttacaaacacctcatcagatcaggggtcattgatcatcgaagcaaagggcagtagctatggaggtgatcgtcgtggaagtagtaataccagtggaagtggtgggaaaagaaattctaaacattatcgttcaaaatcagcaggccccccggaaaacgagaaatcaagaatgaatgggctcgaaaaaatcattagtaaaacgtcgaaaggatggtctagatcaccaaaaaaaaatacgcctgggcttgaaaaacaggtgcttctgaatcccactattagtaatggaggcaccagcagaaggagcagtaataatggagagagtattagtaccaacagtagcaaaagtagcatgggaattacttttggaaacactgaaacttacaagacgccggttgataatgggaaagatgctataatacggcaaagtttgttgagcgaagtgccagttcataccttgagaggtaaaaccagcaacagatcgttgcgagcagaaggtgaacaagctcttgaaagtgacaaagaattaccaaatggtgctgggagtatttacgaaggtgcgcctagggagaagactactagtcaaggtagcgaaccagtgggattagtaagcgattccttacaggttgacgaacagttacagagatactggcatgatacaaggtatattatgagtaccgtagctatgatgcaacacaggagagagacacatgatatagtgaagaggagagaaattgcacgaagaaacgaaattgaaattacacaagatgcagatacaaacattaggaagactgcagatgctttgactcagtatgataatgaattgaataaagttttaaagctaggtaatgactggacatcaaaacttctgaacgactattcaattcgtgtagaaactttgatatcatctagtgacagaattcttagtgatataaatacaacattgacattgaagttgaaaatgtttcaagagaatacagaaaggtatgttacggtgaaagttatgagagcccaaaagatgaccaaaaccatatatcggttgctggaatttggcattgttttagttctttggacaatttggtttttgttcagcgtcctgagaagcattcggttcacaatttttttagttctaaaaatcattaaggcattgctgtggtaatttgcgggtctatgtatttatagaaataaaccatctgcactgatatatgaatatataagtagacatgaaaataactttcatgtagttgaccgggaagagttcaaactctcatcctccagaaaaaggcctctctcagcagcttcatccataatcttttctcttcttttctgttcctcacgataataatttgtctggaacttgagcaattgcttatcagctctgaagacagcacccattgaaatccaagaacaatgataaaaaacacgcacttgagttctgacatttctatatactgatgaaaatcttctcaacagcagcgctgaggcaatactgaagagagcaccttgggcagctcctatacatgatgcaacagtaatctacgaatgagaaagaaggttaattagacttgtgttagcgatttattctggggtgaacaagacagggccagatatattcttgaattttacatacttctttagttaattgtttaacagttttggggtcataatgaatggggagaacgttaccacccatagtagcagcagtttttgtgtcgttggtatttagggacggttggttacagtggcaataattggaaagttctttcacaacaacacaaaaaaggtggagagaataatttgtacggaaaaagttatacctttgcatgtcacgtgaaccaacagaacatggtaatacataatgaagagaagttgcctaagtaccttagctacagtaccaagttctaatctcatcattatcacacatttacaagactatttttgcagcagatggagagatcacttcaaaaatgcgtttatgaaacctatttatgacgaattttttatttatttatttaggtagtttctaaccttctcctcgataatgtttgagatcatagtattcaaagtactatctttctttgatatttggttttccaacgttaatagaatttgcttctcaataatcttcccagtcaaatctacttcaatattaacctcgtcgccaattttcttcaaaggcatgataacattgtcttgggtgtgctttatcatactaatatagaaggctccaccttgcgaaagtgggtcaaccttgattatggtcaaggaagttccatctatacaaatgaatcccttttctactatgtatttaaagtactcttgatctcttaactgaaacccaaaaataattgaattcccctcaggtcttcttgagacaatattagcaacagtgtctacgtgaccctgtacataatgaccaccgaacctaacgtcttgagataccgctctctccaagttgacctgggtgccttgaatccaggaagcgacattacttcgttttatagtttctggtgatatcccaactttgaaggagtcgttattaaactcggtcacagtaaggcataccccatttacggctattgaatctccaacgtgacaatcggtgagaatactccccgcattgccaatagtaatagaaactccttgacctccactttcagagtcatcatatgggttgttttccaaaacagtccccatgcattctacaataccagtaaacattgtgctatggttacgatctcaccaattggtttgacatgtacgttaggaagtaccgtctttttatatcatttggatggatctggaatatgactaatagatagttcaataaccttcctccatggaaattaccgaaaaaaaagaaaaggacggaattggtacccggagagtacttgggcggctactttagttttatataaaccaatatcgaagacagtgatctttttacagcgagcttgaacacaaaataactaccgggggtaatcgttcccacagaggcaacattaatgaatcctgggttaacattaatacctacgcgacaaaaatcaataaaagagattgctagccataaatgaaaaaagaggaaaaaacatgcagattgtttttgagcttttatgtcataacaggtgtatttatagcagtatgaatagttttactagccaatattcattttttttgaatcgatgtaaaatttttggatacaagaaaaattgcacaatgttaaatttctacagaaagctcatgcaaaggatggaaaactgagcattactggcagctttgtggggtagttaaagaagtttattctccgtggttgcagctgtggtggtctttttactgcctttatatcccaattcatccgctttttacccggtccgttgatttgagaaaaaaaatggtactcaaaatagtatggcaaatatactcgatgacatgaataagcggagagcaataatctgtaaagactaaagaaaataagcacgatttggactcccctatttgtcagaatggatagaactcaaacgtttattaaagactgtcttttcacgaaatgcctggaggaccctgaaaagccctttaatgaaaatagatttcaagatacgttgttgctactgccaactgatggcggattgacttcaaggcttcagagacagcaaagaaaatcaaagctaaatcttgacaatttacaaaaggtctcccagttagagagtgcagacaaacagttggaaaaaagagattaccaaagaatcaacaagaactctaaaatcgcattaagagagtacatcaataattgtaaaaaaaatacaaaaaaatgtctgaaattggcatacgaaaataaaattactgataaggaagaccttttacactacatagaggagaagcatccaacgatatacgaatcattaccgcagtacgttgattttgtaccgatgtataaggaactatggattaactatattaaagaacttttgaacattacaaaaaacttaaaaacattcaatggatcattagcattattaaaactatctatggcagactataatggtgcgctgttacgcgttacaaagagcaaaaataagactttaataggccttcaaggcattgtgatctgggactctcagaaattttttatcatgattgtcaagggcaatataatagacgaaataaaatgcattccaaaaaagggcacagtatttcaatttgaaatcccaatatcagatgacgacgattcggcattgagatatagtatactaggcgataggttcaagtacagaagtgtggatcgtgcaggcaggaagttcaaaagtcgtcgttgtgatgatatgctatattatatacagaattagtaagagttattacgtacttccatttgcttcctcttcataagagttcagtgtttcctgaagttgtccctttatcatttccaatagtttgggatcctgtaacttagaccgtacatagacatccaagtcaaatttcttctcaccatcaccattatccccctccattttactacccagctttaggtagttgtccttgaccaattgtgattcaatcaatgcactggttagccctctgtttttaaatattaattcttcatcttcgttaaccatttctttaacagtactggcaactcttttccgaagcgcttgttcaaaagattcactattctcttctgtattattccatgggttagacaatatttctcttttcaacttgtcaaaatgtccctccttcttatacttgtctgatagtcttttactatcttcttgattatacgccattttttggatttgaaataagctctactctcttatactgtgtttcagcttcgctaaataaagaactgattttcttacgtattatttctctagtatctctcgttttcaagatatagaaaaataagacaaaaaaaaaggccatcatatttatacaacgaaaagtgtttaatatggaagcagcaagcggtatatgaactcagttttaaggtgtagtttattttatagtcatgtccattgacgaggctgttgccagatatagagatgttataggcaatctagcaactggcaatttaaggcggattgttatacagtcagaaaaactggcccagatcattgcatcttcaaaaggtaccgttcgtttccaccataaaactcgcagcggtaaaacagtaatatacaaatgcatcaaaaaggcgctgctttccagtgtcgcgtctctatcgtcagagttttcctcagaaacagatgttcagcaattcctccatttaaattacatatatcaatctcacttccaagctttgagtggacaaataaacaaatattgcggcatgaagaaatactacgagttaaagtttgcagcaatcgactacttagaaaccgaagtccaaactaccgggcttacactctcaagattctgggtggcatctttagatgagttcattaaaaaagagcgatggccagataatggatctaactttcaaatcttttacaaactaatggctgagtattcgtcttggaaatgggattctgatgataaaaggcaactccagttcatgtacgaatttcgaatgaaactcaaagaatgtttggtgaaattttacgagaattttgatcttcaaaaatctagcgatcctctgaaagaactcattataccttgggaaaagattgtttatgtcgccaactgtatcgatgcattcactggagagcaagttaggatcgacggtgctgaattaatctggacatccaaaaatcttgtgttctcttcgatttcttctgccgttcttagattaaatgaccttcaaaatatgttcagcgcattccggccttatggggaagaagcattagttcaagactttgcgcatatacgatctttaaagtgggatagtaatgataaagttgaaagcttaattcgtgcccttatttttaatgatatgtttccttatttcaataaggaacaggtagatacgaaggcagatggtatattctttttgcgcttactgagaaaaaacttcaaagaacacattaatgacgttaaagattttcatattcaagtgataaagtacttgaattcccaatttaaaaataattacagcacattgatgacgtcatcgaaaactcaggatagaaggaaaagtcataatatgccttcttctatcttagacgatggtaacaaaattggaatgcatgtttcgcctatcgatgaatactcacattttattgataatgatgaaccgttgtggcgagacaaagtatatccaaagatttacacaaatgagcaaacacctacacctgacgcatcagcaatatttgattctcacaagatatatgcaattatatcgctgctgcgatattacttacctgagaagagaaagttttttcggatttattatctgcccagtatttttaaaaggatattatattacggtgcaaagtttgctcaactatatttcatggaaggttgcttggaacggctagtaatagaatctctccaaattctagaaccctctttggtacatgcgataaataatttgatcaagtctagcatagaatcactcaaaaatgtaacagtgacaagtgatgacaaaacttcatctggtgtcattattttgtcctacaaagaatttaagtcactatctgaagttaacaaagatttcaatgaaccattttggcctaaccaatcaattgcgaatagttggccagatttcgcgaataagcaattaaagaggggtcaaattttgcaagacgcatttgcattccacctttttgaaattgaactaccaattattatcgatactacaagaaatacgcatttgaaactcgtttccaacatgtgtactacgagcatattgtacttatataatgaagttgattccttatcattaactagcatacaggaaaaattagctgttttaccgacaagtaaacggaatgaaatcttattgtacaatttgaacaggctaacaaaattgaaactattgttgttgaaagagaacgaaaaaggacaaaagttttacgcatttaattttaagtacaaaagggatggacagaaaacatcattaataaggttaatttaacaaccgtgaagacagggagttggaccttagcaagttttgtagtaaattattatggaatagtacaacagaatttttttttttctcaatatataattttcctttgtttttacttaaatctgataacagcgtcaatgtacatacaagtggaaattaaagacggaatgaaaatatcataagtgctatgtttattcaggctcaaaagcttgatctgaaacctctaataatacttccattgccataatttgaaaatttacatcattagcgtcatctggatttgcaggcgcaatagttggaccccaaattatacaaagagcccttaaattcattctgttttgggcttcatgtgccaacactcttttcaaatgaaagacaagagcccttaacgtccagtattgtgcgtcggggaggttatatattagtccgtgcataaaattttttcttgttgttgggtcttcaatttgtaaacaaaccttgatctccgatgatagggcctttggtaaaacactatcaggcagcgacgcaaaaaaagttttcagcagtgatcctactaaataaatatccgaatcagaatgtggctttgatggtagaatcatggaaatgtttgcgggatccttatcaatttcctccttcaacttgctgacatcaagtacatttgccgattttctataaattccttcttgatcaagcccaaatttatcaataacgtatatgcattggcgcactatcgcagggaccatgtcttgttcgaattctatcagtgattctagcggtacaccaaatgttttgaaatttttttgaacaccgggtggcatattgttgttagtctgaatgtgagaaatcgggcgatccgagtctaaagagttaatcaattcttctggaatttgtggactattgttgccaggatccagggtctttgttatggatgatgtggtgtcgcttgttacaatggaagaagacggtgacatagcgccagccgcattgctagtggaagaaatagatgaagccatagtaggtggtaactgcttgttggtatttaaggacggtgtagcactgttaagattagcattcggaacagcggcagtgttactactactgctcaaaaatggagattcattatgagtggatatcattctcttcgggatggagtttcttgaagggtccacggcaaactttggggggctcttatttttctgaccatgattcattgatggatgctttttgtatgatacagggatcaagtttttgttgatcagtagggaatgttttcctgtttggttatacttgttcaaaaaactgtaaagatcacgttcattggaaacagatccagcaaatgatttcatagatttggtggagtccaatgggcttattgtaacacctgtattcagaaccaaattttccgtccatatcgtgtacttctgcaattggatagtcatcgctgtgtctatttctaaaatcaaatcttttaattcttgaacaattctaggtctctccttcgttatgaatgtgtttctcaaagaattagaatgatctactttttgcttatattccagatcggcgttatcgatttttcttaacaattcttcttcttgttccttcgtagttttggaacctctcaaggtcagctttgtttttgttgggtcagtcatcctcaatttgtcccaatcttggcacaacgaattgtaacgagattgcgccttttctgcgctgtgtatggcatcagaaacatccttttccagccttttgctgttctccttgacagactttcttaattttgtcattgttaataaaagactactaatctcggagtacattttctgcaaggcggtgatataactctgctttacttgagccatcttgccatcgaatcccaaaacttcgtgaatcatcttttttaaggatgaatttgtggaaccctgaatgttgaaaaagtgcttatattgcttggagagctcctgaacgtgctcttcttcgaaggcgtatttctttctaataaatttcataaactcttcacaagtcaacaacgactgctttaaacggctcaacaaagcgttaattgccacatcggaatttagcaccttcttgatctctggcgtgctaaaaaggtgcgccaaatcgtcggtgccaccatcgtgcgacgacttcgcacttactgtggcactagctggtttcttcgcagtctcttccatcttgtctatatcacttctcttttaatcttccgagattgtatgtttttactttacatactattttgttcacattctttattttctgggttctttttccatatatatcgaaaaaaaagtctatataatggcacaaatggtgaatgccagcacaagaaaaggggcgtatctatataaatctatgcatccttgatcctagtttggcatgggcttgagtgcgtacatcctcactgggtacaattctcttggtaagccacgttgtctttcactggcgatgagctttaggccagcttcttcgaagatttgcctgaacttagcatctgaccttgtgaccgaagaatccgtttcgtcgaaatcatcggtatctgtaggtgtgttattttctttgaccacgattgtcccattaggttgcaaaccaacaatacatcttttcaggaatgcgacgagttctgcatctggcaggtgtcccacgcaccattggcaccagatcagccagtacttgccggcatcgggggtccagtcctgcatccctacttcatatatttgtccaatttggcctttgtctttcagctcagccaattcaacgtgcatttgctcgataaaaggctttaccggttctacaaggtctatcttagcggcgtgcttgtgaagcatggtcttgcttacacgtccaatccccgcaccaatgtctacagcgtacttcacgttgttctcctgaggcagcatcctcgacttcagtttacgcaggaagttattggatcccaggacatccattgtgggtactactgtaccttctccgtatccacctagaacaccatccacagtggcgtccacatccgtccaatagtcgatggcatcttcgtatttgatatgggaatctgcaggcacgtccatcgttgttgtttatgtattctttcttggagatgctcttgacaccgatgcacattaccagagtgaaaagtactgattaataattaaatttttcttttgatattttttctgaatataaagttctacacagagtcgttacaataggttatatacatgaggatgttcgttacagtaggagaaatagaaagctcgctaattcttaccccaggagtagatccaatcgacagagtttcttatctgttcattccaaatatcttttatgctctcccccatggtcctgctccatgcagtgccatcatccgtcacaactagcttgcggttcctggtctccccaggtaccacttcttttctatccaccaggtcctgtacctgatgatcttgtttcaaccatgtagcatcgtgatcgtagaagtagccattgttactgtatcggtacaggtaaaaaacagaaccgattactcccacagagagagtccacttcacagatcttgctaacggacccaatttcgacatgattctctccgttatctgctggttcttagtccactgtctgttctgtcccccttctgtccaagagatagaatataaaaaagactcattatttttttttaggtacttcgcttattggtggtcaatgagaaaaaaaatactaaaagccatcgcctcttggagaagagcaaactatcaaaaatcatcaagccgacatttccacatcgagtctcatagtctttcaatcatgtttcccagagcttctgcattggccaaatgtatggcaactgttcatcgtcgtgggctactcaccagtggtgcacaatcgctagtctccaaaccagtctcggagggagatccagagatgtttgacatcttgcaacaagaacgtcacagacaaaaacactctatcacccttatcccatcagaaaacttcacctcgaaggccgttatggatttgctaggttctgagctccaaaacaagtattctgaaggttatccaggtgaaagatactacggaggtaacgaaatcatcgataagtccgaatccttgtgtcaagcaagagctctggaactgtacggattagaccctgccaagtggggagttaatgttcaaccattaagcggggcacctgccaatttgtatgtttactccgctatcatgaacgttggtgaaagattaatgggattggatttgccagatggtggtcacttgtctcacgggtaccaacttaagtcaggaacgccaatttctttcatttccaaatacttccaaagtatgccataccatgtcgaccacactacggggctaatcgattacgataacttgcaagtattggccaaggcattcagaccaaaggtgatcgtggccggtacttccgcgtactcgagattaatagactacgctagattcaaggaaatttcccaaggatgcggcgcatatttgatgagtgatatggcacacatatccggtttggtggcagccaatgttgtcccatctccatttgaacattccgatatagttaccacaaccactcacaagtccttgagaggcccaagaggtgctatgattttcttcagaaagggtatcaagtctgtcaccaaaaagggcaaggaaatcccatatgagttagaaaagaaaatcaacttctcagttttcccaggacatcaaggtggtcctcacaaccatactatcggtgcaatggcagtggcattaaagcaagcgatgtctccagaattcaaagaataccaacaaaaaattgtcgacaacagcaaatggtttgctcaggaactaaccaagatgggttataagttggtttccggcggtaccgataaccacttgattgttattgacttatccggtactcaggtagacggtgctcgtgtcgagacaattttaagtgccttgaacattgctgctaacaagaacaccatcccaggtgataagagtgctcttttcccctctggtctaagaatcggtactccagcaatgaccacgagaggatttggccgtgaagagttttctcaagtcgcaaagtacattgattctgccgttaagctcgctgaaaatttgaaaactttggaaccaacaacgaaactagatgcaagatcaagactcaatgagttcaagaagttgtgtaatgaatctagtgaagtcgctgctttgtctggcgagatttccaagtgggtcggtcaataccctgtcccaggtgatatctaagtaattatgatttaaaatcaaatactttatgtattaacatatacagccactgccgcttttttttttatttatttccagtatatttccctgttcattgttctttgacaatgtcttgaattgactttcgggaaccaaactgattattattttattcaatgtatcgaaattgtaccctgtctttgcacttacggccacatacggcagaccctgtaactccgccggtatagtcacttcccctgaatgctcttcgcagactaaatcgtacttattgcccacgataattacctgcgttccctgagcacggtcctgtaaatcttgaaaccatgtctttgcacattgcagactggatacgtctcccaattcgaatacaatcaaagcaatattcgcatctcgataatacattggcaccagtgatttataccgttcctgacccgccgtgtcccatatctccatatggatacgtttctccgtagaggagtcgttagaaggaacctcgattgtcttggtgatgaacgccgcacctatcgtagccgcatgttttgctagaaacttacctgatttgagcctagtcactatactggttttccccactgatgaatctcctagcagtaccactttgatggttgcttccatatcgtattcctccgtattttgtgctacttgtatttcctggagtaattttactatcattgttccttaacgtgaaacgtaaggctaaaaaacaataaacgacaaaaaaaaaacaaaaaaatgaaaaatgcagaggagtttctctgcatttactggaagcgattaaataagattgcctcaagaaaagaagttatcggtataatcttttgtaggtaatgaagtttacgttagaagaccaagttgtgttgatcactggtggttcacaaggtcttggaaaggaattcgccaaaaaatattataatgaggctgaaaacacaaagattattatcgtcagtaggtcagaggctagactgctggacacatgcaacgaaattaggattgaagctcacctgagaagggaaaccactgacgagggccaagtgcaacataagttggctgcgcccttggaccttgagcaacggttattttactacccatgcgacttgtcctgctacgaatccgtggaatgtttgttcaatgccctgagagacttggatttactccctacacaaacgttatgctgtgcagggggggctgttcctaagttatttcgtgggctaagcggacatgagttgaacttgggtatggacatcaactataaaacaactttgaacgtggcacatcagattgcccttgcagagcaaaccaaggaacaccacctcatcatcttttctagtgccaccgcgctttacccatttgtgggctattcccagtatgcgcctgcaaaagctgcaatcaaatcactggtagcaatcttaagacaagaactgacgaacttccgtatcagttgtgtttatcctggtaattttgaaagcgaaggtttcactgtagagcagctaacgaaacccgaaattacaaagttgatcgaaggcccctcagacgctatcccatgcaaacaagcatgtgatatcattgccaagtcgctggccagaggtgatgaagacgtttttacagattttgtcggatggatgataatggggatggaccttgggctcaccgcaaagaaaagccgctttgttccgttgcaatggatttttggtgtcctatcaaacattctggtcgtgccattctacatggttggctgttcctggtatatcaggaaatggtttcgtgaaaatgacggcaagaaggccaactgagagcacatccactctcattcccgatattccccgtgactctctttatttctttcaagacaaaccctagtggtgtagctatttgtacatgtataagtatatacgaaatattaattataacattattaccacggcgatattttcctatttttattctcttttcttactatattttgaaagtttttcttatgggtaccgatgcgatgaggtgaaaaaaattttcctctttccacttttagtacaggttatgagatgcttctcattagaagtcaagaagagagcatatcagtaacaatacgatgagtagcagtggtgtttatacgtgtaattcatgtgtcctgacctttgattcaagcgacgagcaggcgggcccacatgaagtccgattggcatcgctacaatttgaaaagaacgtgttgcacaattgccaccaatatcatttgagacatttgactccaaagtgtctgcagctgctgccagtactagtaagtctgctgaaaaggagaaacctgttaccaaaaaggagttgaaaagaagggaaaagcaagcattgctcgaaaagaaaaagaaactgttggaaattgccagggctaatatgcttgaaaacatgcaaaagagccaagagggaaatactcccgacctaagcaagctctctttgcaagaaaatgaggagaacaaggaaaaggaagaacctaagaaggaggagcctgaacagttgaccgaggaagaaatggcggaaagagtaatgcaagaaaacgtacgcaacagagtcgatattccactggaacaatgtctattttgtgagcacaataagcacttcaaagatgttgaagaaaacctggaacacatgtttaggacccacgggttttatatcccagaacagaaatatctagtcgacaagatcggcttggtaaaatacatgtcggagaagattggtcttgggaacatttgtattgtttgtaattaccaggggagaacgttgaccgctgtaagacagcacatgttggcaaagagacactgtaaaattccctacgaaagcgaggatgaaaggttggagatatctgaattctacgattttacaagctcatacgcaaactttaatagcaacacaacaccagacaacgaagatgactgggaagacgtgggcagcgacgaagccggaagcgacgacgaagatctgccacaagagtacttatataacgatggtatagagctgcatctaccgacaggcatcaaagttggccacaggtccttgcaaagatactacaagcaagacttaaagcccgaggtgatactgaccgaaggccaaggtaccctggtcgctgcagagacgagatcgttcttacctgccttcgacaaaaagggcgtgcagactcaacagcgtgtttggcaaactgagaggttcgacaagaaaaggctcgataagagaagtgccaagttcgtcaataaccaaccacactacagagaccaacttctgcagtaattctttttgcactactttttttagtattttgtcgcatatatactgcttcaccatttgtacattagataattcttcactaccccctctatagcaatgttatagtcattgaatcatgctttgaaatgcctgttctaatattctcttcatataataaatgcgtgatgccgggtatttgtgcgcccttgtttggcgcaaaaatctcgaaagtgaaaaaactaataggcttcttaaagcagttatatctacagcaaaggaaatagctgctgaagactgaagatgttggcgcgcagtttgggttacaggttgatatcgaccagtcgtatcttatataataaacccacggttaagtcagtggtgtcgtcgtgtcctgcgggaacatcgcttaacttaaacatatggaagagcggtaaagacgcagtggcactcgaggacaaggagtatccaaattggttatggagcgtattggatagtgatcacgttgtcgaacatgcggctgaggacccagagggacaggctctcttaaagagaagaaagaacataaggaaggcgaacaggcagcgaatcaagcaaaacaatttcttgagccaactttaagcctccgttaataagatcaagtttggtatccttgtaaataaatatgtgtgtacgtggttaaatagtatgtttttagcataatgccttattttgtaccaacaaaaacatgatagttcccacatatcttttcgcctggggaataccaagtgggacaaacaaaacgttaaaaattaaatcctttagagtaccacaaattcgcaagaaacaagatagttgaattgtcaatcatggctaagataagtatgaatgtgcccagtgtaaagatcaaaaacatgccaaaggtaaggttaaaaagcactagaaagactgtctccacgaaaaacatgcgaaataggttcaattcatactcgaaaagaattcgaaggacgctcacaagaaagagattttaggcaaacatgaaacgtatgcatttcataacacacacatatatatattatatattcaaaataaagcataacaacatacatattgaaaagtaaattgaacgttacgcagtttcatcaaataagaatagtattattaaaaattggccggaccaaatatctagaaatccgttactcttccgttaaacgaataatcgccgtgtctcaacggtcctgcttggacccccaacttcaccagtcttggggttaacatcaccttcgaattcaggtatggtcttggaaaattcaggcgagaatgacccaatatcgtttttggttaaaagcggtgaattcaaactctcctttgtacgatcgccggtggcctgcgcattatactgatctattgcctcttgcgatgtggcaatcctctgaagtctttcgaactcttcctgctcttctcttggcagcttgggagggccggggatcctttcagtagttatttttcgggtggccatattaaatggtcgtccacgtagtagatttaaggctcccgtgcgaggataccgataacctgtgcttttgatggcgcacaacattagttcttctttttattatttggttctttctgactctttagcaagttaatatgatctgcactttccccattggcccctttatagggcggaaaagagcatctgtttttccggattcttggaacaagaaaaaggaaatacacctatctatatgccactattgtatattactaaataaaatatttaattatatactcatgcgtatgccctcaagaagttcaccaataattctttggtttctgctgttaccttttatggtattcaggatcccaaaacactgcagcagcgtcagtttatcttcctctgtgacgccgttctgttcttcctcgctgaaaatatatctttgaaaactcttactggcaccgtcatttgtatgtaggaagctttcgtaatacggaagaatgatggagtctctaaaacactttaataaaaggacatcaattgacggtgcgtaccttgaaggttcagatagatatccgtcaagccagtagttactatttttttggaagcttttctcgaagggcagtaacactgccatcatgtcgtagtaaacctgttggtaaaacaccttccagattatgccgactcttttcaaagccgtatttacggtatcctcattggcataattgaacacaatctggttctctaaaatgtaaagtgaagtggtaatgaattcctcgatttcggccaaaaaccttgagtgcgttacggcagccttggtttgtgttttcaaagtgatataaaattccagcagccggtcaatatcttctatttttgctggcaattgccataccctcttgtttttaaatagctccacaactatgctgcagtatataccccagatattcccctccagaacaaataactcctgtacggtgaagcttttatagtttgctatcaaggatggcaagtttttcagtaaatcatgtagtaaagaaacattagtcgcgtcgaaagcatcatcttggatcagcgatagagctgtatcattagggttgttgttaatgctagggttaaaggaatatacagattttccagagtcaataaggcctccagtagaagtatggataaactgtacgggtgacctatgtttaccatatgaagaatgcagaaatttactgaatgggctgggaactacgggttcaacgtcgtctttaccaatggaattatgcggcttgtagggtaaaagcttttttgccattttgctaaagacattactgcctttgtttgaatgagaatgtcctgtagacagtgaagattgtaaactgttcacactcatattagatttcgtatgaaacaatttagagccactcctacttatgttgttactacttgtgccggtaataacagtgccgtagttttttgacgccctcctgcttcgatttctcatattatcttttgaattggtgaagatggacagtcgccttttattgccccttgagttggaagaaaataaactatcattagacgtggtgttcccctccattcggttactacttgatgaacctatttcggagtgaccatcgttattctccgtgccttggctgtactcctcttcaatcgaatccgtcgagcgccttgcattggaaccatcatggaatatagattgaaaccccacctgtgaccatctaggagcggcatcatgaggagatttggatgtttttagatgcacatcttcgtcgggatgtgtcagcgcttgcggtactatatcagaagaaacactataaactctagctggtttgcgattagttgcttttatgttcgggttcgtgacgctcagtgagcctgaggtagcacttcttttacgatttaggtctgttgccattgcttgactctgtagtttaagactcgcctagccacttatgcttattgtggtttgtattttttatttactgtcttctatctttctccctttaattttgaccttattttaaagcccgcaaagatcgctgaaaaattgctagtaaaggtcgcatgcaaaatggataaagtgctcttgtcaaattatttcaacaccttcattcgcagtatagtggtatattggattgggtaaaggaaaacaggcgacaccaatattggtttaagctagtagcgtatgcagctctatccaggcattaaaattggttcacctatttctgatagtagtttttttttttccaatcgtaaattttttcttcaatttcgcgatgagctacaaaataatagtagtgcaatctgtatattacttttcaagtatctaactcatgcaagttaggagttccatagcggatatttcactatgtttgatcctctcgatttgtacacccctgatgacatccaggttgaggctttacagttcaatctagcagagagagagccaaaagatccttgctcaccgcaacgtgacgaaatattaacggctgtagatgaagaagagagtgacgacgatgacaccattatcgataatctggatctgccctccgtgaagtatgctccgccagaagttatcctttgtatactaatacttctgaagcccgatagacaagtaaacttcaatcaggagacagggaagaacaaatctgtactggaggtttgcaagagtcatgggctggaacccgatctgctgaaaagacttttgacttggtatacagaagaatggcctaacaagaggttaaactcgttggaaaagatatgcaataaaatcccaatgctgagatttacagtatccaaagaactactgttgggctactatactagtgtattgaaaaaatacaataatagttgcggattgaatgaggaaatcatacaagaacttcttaaggaattgagctcaaggatatccgaaaactgtgggagaacggcccaaccatccatagtaagatattttgaattaagaaatctaagcacttccataccgcttcatgaaccctctttaacggccgataatcttggttggaaaacatggggatcatctttaatactttcacaattagtcgtagatcacctggattacctacataccactaatgtgaacatgttagcgaacagcgacatcaaacagattaaagtattagaattaggagcgggcactggtttagtaggactttcatgggccttaaaatggaaagaactttatggaactgaaaatatagaaatcttcgtgacggatttacccgagattgtgacgaatttgaagaaaaatgtgtcattaaataatttaggagatttcgttcaagcagagatattagattggactaatcctcacgattttatagataaatttggacatgaaaatgaatttgacgtcatattgatcgccgacccgatatattcgcctcagcatccggaatgggtagttaacatgatatcgaagtttttggcggcatcagggacctgtcacctagaaatacctttaagggcaaaatacgccaaagaacgagaggttttgaaattattactaaaagagagtgatttaaaagtagttgaagaacggcattcagagggtgtggatgattggggtgccgttaagtatttatataggcaaatcgttcgcaattagtgggaaagaaacgaacgcgcttaggcgaatagtttttctttataataaaaatcatgcatgctacatagacattgaaatgtgaattataagtacttgccagaccttacatactgatttatacaatttatggagaagaaaactgaatgggccacctcgccaaaaggttagtttttgattcagacaggaatcaatactggtagtacattaaacaatcaaggccgcctttatagttgcgcttatgcaacataatcatctgcaatctgcaatcttagtttcactgcctgtggaataattttttccgttaactgctttggagtattctcgcaataaaggttcataccatacacttaacttttcttcacctttgtccagtaaatttctcaaggcagaattcctataatgcacagtctcaagatctataatagcacctgcgctcccatcacctatcaagctgcccatcacctttggcatctcattgagcagaaattttgaagtgtattcgtatctcgtcaaggtttctactacttgcatttgttctaagtacggtagtcttaagacaatctcagcactaaacttgtttcttatagcattgaaacattcttcatctgctgaaagatttctcaacattccaatgctgtagccactgacgtgaaaatagttttcgaccacatctttatgatattttaccaagtactgcggattaattaattccaaccactcggttattaattttgcttcggacccaatttttaaagaatctttgtccatagtcttgaataaagaatattcatcttcctcaattcgtgacacctctgcgaataactgtaaaagacaatttgtagaaaaggccctgacatcaggatagttctccgtgtcttcaaaaagttgagcaaatactggcagtattttttttacatgtcttaaagcccagtatttatcttgatttcgtatttccagcaaaaacttagtataataattaaccaattcgatgaaaacgaggatatcttcaacggatttcagtatctcttctttagtaaagcaaaatatgatatccttgaactcaggaccgctgatgaattgaaactcaatagtcaagaagtcaattaatctgacaaaagaaaccgtttccattctaccctttacgctcaccaggtatggcaaattattatcaaataatcgacgcctaatcaattcatctgtactcaacctttccaacgctttttcgattgctgtaatgagcttatcattctccactttctcatcaaatagaatatccaatagaatatcgatgatattactggtcgcgaataaaccctttggctgcgaattctcaatgactctacatgctgctacttttaatggatctatttctgacctaagggccttcactaagtcctccgcgctataaacttctagaacatcgtcaaaatcagccatgggaacaagcttgtccacaacgtccaaaaggtaatcgtaattcaatgaatcataggatacgttagacgtcagaaaacgcttgatcgtagccagtagtggtttaacatccatatctggaagggagacaacagtcacaagattcaaagaacatttccttaatagtgtgttgatatcttcaggcaagttatcttcattaagttcattttctaattgcgtaaggagattttccacgtaatttgtttctttctcactcattgctcctgtttcgctgagttcttttgcggtgattatagttgtaaacttgttttatttttaatcccgtaattaaggtgtttatataaacttactcttcaatttttctatatgcatttgaaacagaaaaaaagatataaaaataccagctataacaaaaatccatgtaaataaaattactgtatatttttttatgtaatctaatcaaaaaaaattcacgtctaatactagtcataaatggagttgaagccattaactacttattttttatcttcgtcctttttcttttctaaatggacattattaccattaaaggttgttgggtcttcaggatcttcttgatgatcgttgttaacaaattggaaaacatttggcgagacagaacgtgacgtagtaaggttggtttccgatgggtacctggttccgctaggtgtcagcattggtgatgcatgagcagatgattgaactggttcccgaacattgttgtattggaaacagcttgacgaagcagctccagataaaggtgttgaagacctcacttcgtgacgattcggcttcgatgtttcctcacgttgtgatgttacttcaggatctttatcgttgtgccaccacgtagagaatcccttataaagacggcccaaaaggcttggtccctccatcccagtcacagatagccccgagttttgagtttctagtggtttaagtaataatgcagaccttggagttagttctagtgtctctagcgtcttcaattcatcagaatccttaaatgtcactctgggaatgcccctgtggaatgagtacgggcagtctccatctgtcctgttgacgtccacccattttctaacgtcatttaatgtttcagacgagttgaactcatgttttagagtcttgccatcagtcatcctgatttgcaagacgcatttgctgctgtgcagtttttgtgcgtcttttatgtaatcatgaacatccaatggcttatcatcatcaagggttctgtgatgagtttcatcaagagcttttctttctgcacggtctgccctaacaagtcttataattctttctctttcctcctcagccagctttctttgtttcagttgttcacgacgttggatctctaaggtagtctcagcaatccgttctcttgcatttttcctatggacgtctctggatgacttttcttctctagccaaacctggattggtttccctggacgaactctcaccagcctttttgtctttgatgcctatgcacgccagcaacttctcccaatgtcggtcatcctcgccttgaataatcaattctatctttccagcacgtatcaagtatatactgggtacaactacattaggaaatacttgctcaaataactggaactgctcagtgtctttgaccaacctcaaccaaatactatgttccgctaaagtatctaatgagacatcatctcctttaaaccaacttttcagccactggtcatcccgtgcagtgttgtaaacggccagcacaacgccttccttgatggaatcgtttattgcttcttccacagaatctctaaacagtgcttctaacatttggttacggctgtttggtttagctatccttgcttctttgtaagtgctttcaacctcaacccagctcccttttaaattttcaacattactacgaggcctgccgaagttaataaagagcggctttaaatgtcattttaataattgaatggcaaataaaaacaactacagcttcaaacataagagtatatcataagttgctgtatatgggcagcacgtattactatgagtctctcgcaggtgtcacctttaccccatatcaaggatgttgttttaggagatacagtaggccaaggcgcattcgcctgcgttaaaaatgctcatcttcaaatggatccctccattattctagctgttaaattcattcatgttcccacttgcaaaaaaatgggactcagtgacaaggatatcacaaaagaggttgttttgcaatcgaagtgttctaagcatcctaatgttttgagacttatcgattgtaatgtctctaaagaatatatgtggataattctggagatggcagatggtggtgatctatttgataagattgagcctgacgttggagttgattccgacgtggcccaattttactttcaacagctcgttagtgctattaattatctgcatgtagaatgtggagttgctcacagagacatcaagcctgaaaacatcttactcgataagaacggaaatctgaagctagctgattttgggctcgcctctcaatttaggaggaaagatggtacattacgtgtatccatggatcaaaggggttctccaccctacatggctcctgaagtattatattctgaagagggttattacgcagatcgaacagatatatggtctattggcatcctcttgttcgtattgttgactggtcaaacgccttgggaattaccttcattagagaacgaagatttcgtcttttttattgaaaatgatggaaatttaaactggggaccctggtcaaagatagaatttactcacttgaacctactccgaaaaattttacaacctgacccaaataagagggtgacattgaaggctttaaagttacatccttgggtattacgtcgagcttcattttctggggatgatggtctctgtaatgaccctgaactcttggctaagaaactgttttctcacttaaaagtctcactgagtaacgaaaattatttgaaattcactcaagatacaaactctaataataggtacatttctactcagccaattggtaacgaattggctgagcttgaacacgactcaatgcatttccagacagtttcgaatacacaacgtgcatttacctcgtatgattcaaatacgaactataatagcggaacaggtatgacacaagaggctaagtggacgcaattcataagctatgatatcgctgccttacagtttcattctgatgaaaatgattgtaatgaattagtaaaacgacatttacaatttaatccgaataaacttaccaagttctacacgttgcaacctatggatgttttgttaccgattttggagaaagccttgaatttatcacaaattagagtaaaacccgacctttttgcgaattttgaaagattgtgcgaattattgggttatgataacgttttcccacttattataaatattaaaaccaaaagtaatgggggttatcaattatgcggtagcatttccatcataaagattgaagaagagttgaaaagtgtcggatttgaaagaaaaactggtgatcctttagaatggagaagattgttcaagaaaatttcaactatctgtagggatattatcctaattcccaactgaaaaaaatggagacaaaagaagggttaagatgcactgatcaaaaaaaaaaaaaaattctttctacttattatatatctctctcgatttctagtgtgtcatcgtaactatatattgtttcgagagattttattattgtaattaatttattgccattttgatctattctacatactaacaatcaattcatatcattatccctgtttgagtaatattcgagcctcatcataaaatctaataattcaattctcaagtttcttctttcttccacagatattccgttcaagtcgcccggtgtgaaccctctcaatctggccactaaccttctcgacttttttgaaaaaaagtgcacttttaatgaaggtgtggcttccctagatgtagcatcttcgttaccatctccccccaacaaaggttcgccatctgcttctgtgtgggcttggcctaattgaatttcatggtgtttttcttttccaccaattgtttttggtacggtgtctaagccattctgcgcgttgatatttgtattttctgtcattcgaggaggtgaatctggtggcattaactcattcctttgcaatctctttttcaatttctcttttatttggctctttgacccttgcattttcaaagaattgaaaatgggtatacgaatttctggtaacactgaaatatcagcaacttcgggttgttcttctagacctgtctctttagataccgcatgttccattgattttaaaaagccctcatctctgacattttcttcaacaggtacaaaatcgtcattaatattggcatccttatctcctttaagcggtcccttcaaatttttattaagttcgcatgttccactatcttctaagcgtacattgataccttcttcggtcataacaacttccctagattcttcttcagtgccttgaatgggtgtgctgtccatcctgtcattatttttgtttctactgtttattgcacccacttgatgtttctcttgcgcaaccgttccatgttcatcttcatcactacgcaagtcatcaacttttgatttttctgtctgctttgaactattgagaagtatagtcccactcgggatctgaatgccgtctcctggcacctcattccttactggagaggcttgttcaacattacaagcataatcgttgttttcaccctcattattaggacgggctttcttcacgctcttgtactgtgcaatattgtcttgcgtaaaacttttactgttgattttattcatactttcctggttctcctgtctttgaacatgttcaacttgcccttttccatcttcctttgttatggtttgctggtcaagatctaaagtgacattcaaggaattttcattacagtttgtttccacttttatgctattccttaaagctaacgaagattcttcgttggctatactcttgatgttagtacatataacgtcactgctaggcgacaccgcttgttcctcagaaactaaaacgtccaccatcgtttcatgacctttcgatcttttattttcagaggtaggcgtctctttggaaggtcgttttagaggattatcactgttaacaacgttatgatcaggattcgttttgatagatctatttgttaccgccttcagttcgctagtgagaacttctatcggttggtatgcgttcacttccgaggattgtgtatcaatactttcatgcagctcagtaacatccacctcatcgcttttagtagaacaaatgttgctatgattggccacgtttttatctaactgcgtactcttcatctgctgatctatttctctaatgctttcattatccacttcctctagtgtttcatcatcaattgatctgcttcggttagcatgtgattcttgctgtgaagaattcattattgcagtatttttaagcgatattgaatctgaatctttcgcactaatctgggaagatatttgaattgaggagggaggctctttcattccctgcgtagccggaacctggatatcttgagaatccacttttctctgtaagtttgaaagtttattttcactcccttcgcatggaatatacatcgacttagtgtcaggtatagcttcaatttccttacttgagtccccttgatgaaccacgcccgattcctgtatccactttcctattgtctttaatgttgcattataggttctcttatctttaaacttacgattatgtgatttgatgaggtcaatcaacagattaaccatatcaatagtttgatagttagggtttggcggtaatatactaattaacatggaaaaaaattttttggcggcacttctagaaagcggtttagtgagatataataagactaattcacggagcatatttgtactctttttgtgtttttgcatattagagctaactggatttaagaagaaaactaaaagtggctcctttaatttttccaaaatttggatctctttttgtataataatcttttcaagcaactccaatatataatcatcatctccattttcaattttttcaataactgctgccagtaacttcccattaggcttctccttatacgtcagtaattttaacagtagctctggacttattttgaaaagaacttcgctggtcatatttccgcaaaattcatccaaatgatccgccatattattctttatgcaaaaattcaataggccactgaataatggttcaatgggatttgccatcgccagatgaaggagttctctgattatttctgatttttctaactcgctatcagacgcattttgtaaaacgttctcgatttctgaaaaattttgatttagctgttcaagttgttgacccttcaacagccaacgaactaatgtaagctgttcggagcacttgaatagttttatgtttgctgcaaaatatgaagctctgctacgtggtaacagcttcaataggagatctgaatttagatcagggatggaatttagtaaatttggattggaatgaatacagtactccaaaatatccataaatttgttacgccttaaaaatgggagcagaccggaaaacagttcaggattccctggtaaagaagtttttaacagcgtgatcagatccacgtttaatttgttttcattttttgaaacatagctttgaatgaaataaataaaattattgttcgaccacatagacacatgaagtagtgtaaacaaattaactggaaagctgagcttcaaacataggtccaagaaattttcaatggaattttcattcggaactttgttcacaatattcgccaaactctgaaattctctgaaagatatatttggtggtaataacgttgatccaacccaattttgggcatatacttctgttttcttatcatccaattctagaaacttttctattatcagaaattcagatgtttcgtttcgagctttcctgataacatcttttaaaagatcaagggtcatgtttccttgcgaaataccaactttggaaatttggatattgaaatttactaatgatgaatcattctttcttaaaaacaggtccaaaaatgtataaacaaacgatgaagtaacagcaccaaaaaagtcacgaaaaatgggtgtatctttgttgttttgcgtgacttttaatataagactgctaaaggattctaaatgagtttggtcctttctatcctctggaagatgcttcaaagatgtaaggatcagatcatgagccaaattaacgttagaaatggctacttcaacagtctggaacacaactttcatgattttatcgtattcacgcttgatgatctgcgggggcaggcttgaaatgtcttttaactttacaccttctgaggctataacactcattgggtgaatatgctttttatattttctttccaatgcaacatctgcattctttcccccaattaacaaatgcaaaactgtgaagagtacattttgcaagtgaatcgaatcatatttgaaaacataatcttcataaatcggggttattaggtggtcccaaaatagttcaaacatatctgttgacaaattcttattacttgtaaatgcagtgtaaacaacacctaaaaggtggtagatgatcccttctctagcgcttggatcattcacataaggaagcgtcatttgaaaaggggttcgtaaaagtgacagtaaacttttgtttccttcctgatttttctgtgatattttcgtgcatatgcagtaggtaataattctccaaactttgatggacattaagcgagtcttggggtgattattgataaagcacaggttatttaaatcaaaccaaactttgttagattctgatgtcaaatcataaactctctttccgctatcgtatagtaatccggtcattgaaagccacaaatccattgctattttattgtcatttttgaccacaatatagttttttatctgctgtgtaagaagatgaccaattgtcactttatctaaattagcgctgtcatatgaatttaacggtagtttagataaaaatttttccgggattgtttcgcatactggagatagcatgatacactggtaaatcctttcatgttcatcaacaaaatctaagcatttttttagtagttccagtaaaacaactattgaagttatgagaattttcatggagtaaatttcatctccgataataatcctaggtagtacctcacctggtaaccaagaagttaccgtctcaatcattaattttggatacttgctcaaaaatccccttataagtagcaatttttcatatattaggttgtgactattgatttccattatttcagtgaaagtgctaatgataggtttaatttcttcgttgctcaagaaaaaagtaccaaatttttcgtctctcaagaaagagacttgtgctgttatgattatcttgtttgaattttcatttcttagcgcaccggtggtccacctgtaaataacttttaacttattaaccaaatctggccttttcgttagccacttaacgattttgaaattagacataatagcactgaagaatcgaactatttgaacatatagtctgattacaaatggattttttttttcactactacttaataatgtgtcctgtgctatttgtagatgcggtatgcatatttcaatgatactttctatattcacaattagaatattgaatttctgatcaacctcgttaacatttttagtggttagaatgggtataatattattaaaggttgcgtatacctcaaacctcctcgcgacgtaatcttcagattcttgtcgcaagatgcccaatccgccctcaataatttctttaaactccgaaacactttcattatcaactaaaccatggatctcaccactcacccaatactctaaggcgcgaggatttacccttgtttccttataaggtgatgtgaaaatattaccgttgtgtaatttgtgttgggtatattggagtttattgtaactcaagtcgcttacagtcctcactgaaggcaacctattcctcaaaattgattttcctggtttgcttgatggagagggtttaggtgaggaacctggtatgcggtaaatcggtgatgattctatcctatcagaaaaagctacactttttgtaaccggtgatacattatcactattagaggcagacaactctggaagactttgcattagcctgcttcctgtatcttctggatataaattcttgttaatagctgataaatcaaattgtttattctcgcaatcacttgaagacgctagctttcgcctctttggcgttggcgatagatcgctttgtatatgcatatgagcttgtggagatggaggtggcaagttagttttcatccacggagagcttccattggaataattatcgtgttgagacctacggaggatatgctgatcaattcgatctatcgtatgtttctttttatctgaaaaatctttcgacattgcaaattgaccacaaaaacgattttgcaatggcaatcctgtaataacgttgacgaatatatatatatatattcacttttatctccttaggtactgatgccgacgaattgcctcaaatcgctctaagactgcgttattactttcgatcttcttgctaacgatgagtcgccaataaataaaaaatcgacgacgtcggtcaattatagtaacttctattattgtagtaaatatgacataagaggaaaaacacaaagaactgaaaatcaaaatggcactaatcacctgccttctgttgacttcttgtttcttatcaaaagtagagtatattcacgatgtaaatctaagatagctgtccttactatataaatatttgctgcggcccttttttaacgatttgtaaaggattacagcagttcgttatacttggctgatagcgttaattttgcatacttttcttataattggtaattttcctacgtattatacagttgtacgtatacttatataacaaagttcatgtgtacttcatattaacctcagcgatacccctacagatgatgtgccaatccatagttttgtctttttcgcgattataatgctttttccaccatttgaagagctcatatacgaagaacaagtttggttgaatgataacattaagcctccgtaccctcacaaacaaatacgcacttgccaggtcacactggagatatctcatacattcagctatacaaactgttgcagatctggagactccgaccatacaatgcaccagaactttccctcctgttgcttcggaattgctaataaaatccaaaactttgtctatttggtggaaaagcggatctttgccgttgtcatctagattttcgatctggcaaatttgaaatccagaattttcacttattactacgttgctgccattttcttgcttatcgctgaccacagtatcagctctatttctgcttttattacatgtagtattacctgcaacttcattggtattcgtcatagttattgcacgatgtggccttacaggatgagcaattttatccttattcaatgtccatgaaacaacttcaccgacagaaactatatgcgtaattcctagagacttaagtaaggcaggattttgtgcatgatccagggatcccaaatacaagtgacgtagaatccgggatggcagtgggcccttcaaattaacgaaattagactcaagaggaatcttcataaaaaatatgctactaaaaagctctgaagaaatgtgtaattgaaagcttttatccctaaatttcaatgcattggcatataattttagattacttccattctgcggactaaactcccgcaggacaggttgtaaatggcctaaaatttgcaagtctgatggaaaaaggaaaaatggtcttggatggatcctcaaaagagcgtcttgtaacggaatattaaagtggaatataatataagctgttaataataatgacgtttctgtatatccgtcttcgcaatacatgaacgtcaataattcttgaacttgggatacttgaaatattaaataacaaacattcaaaagaatttccacagactgaatgtttaagttccccaaacctatactacctgaggcagggaaagtcaaatgcaaatgctcttgtgattttgacgcatcatcgtctaataaaagatctagatatgttcggattttcgttaacgacggcatttgcgagtttgacgtacattttatgatcaatttccacacctcttttgtattcggtatgttatacagttgagaaatggaggttgtcggattgtccgtatcataatttagagactttaaatttactatgcttgtattctcttcgaaacggtgggtcagagatatattgttttttttaattatttgataattatgccaatcagtggtgttaccgcaaatcaaccctgtttcctccaatcgtgtagctgaagtcagcttattcaactctaacttctcgcacaaaaccatattcttatcaacgttattgaaacacactatttcactaggtgacgaacataaattcaagggagtattattcttgaaaaattcgttgtctaataaaggtgtaccaatcaaagtttgaggtatatctgtattgaaattctgataagtgcaaataaaaagattcgtcttgtaaagcgatcctccactccctacataacccttttgaacaaacattaaacagatctgtaaaagtagtgcaagggttgtacaattggggcaatttccctcgtgtgagcacgctggcgctgattctgtttgcatatcagtgctgccaccagtccgcgaacaataaattactatattatcaaccatttctatcatcttggcacattgcaggtcgaaccttcggaatagacctctccttccccagacgtcctgcccactccgttttagcgtggtattagacccaaccttgtttctagaataccttttaagttctaatgatagtccacgaggatctactttcagaaatggtaaaatgctatgattgtgacaataagtagcagcgttttccaaagcaacatcatccacttgcaattccaattgtcgtatctgaaactttagcaagttcaaaagttcctttgtgttattgggatattgaaaaccattagaatcatttccagtttcacaggtatcgccctctctatgaaaggaagtgcgaactttccaggactggaagatatcattcacttcgagagaattacgcaaaagcgcagaattgttagcatctgattgcgatttgactattgcaagagaatgaggaaaatcgggtggttgaccaaaggaaatatcatgagcccaggggaacatttttttacattcaggccattctgcatcctgatgtagtcgcataagatcatgcagttcaccaggtgtgattgagggcacttccaaaaccatggttgttgctctagttttctatacccgccccttctacctcaatgacaatctctcttttatggttggtgtttcttttcacttttttacttcttcttgtacttttctttttgaaccttaaaaactcttgcaattatgtttccatgatgcttttgaagtaataatttatttttattacgcgaaattaatggccttaacaactgcctgccccaacagataaaaacaagcaagggtcaaccgtgttgcaaaaaaaatgtccaacttagttaaagaaaaagcacctgtctttcctatatctaaagtaaagaagattgccaaatgcgaccccgaatacgtaattacatctaatgtagctatatcagcgaccgcattcgctgctgagttatttgtacagaatctcgtcgaagaatcgctggtcttagcacaactgaattcgaaaggaaagacaagcctacgattaagcctaaattctatagaagaatgtgtcgaaaaaagagataatttcaggtttctagaggatgccattaaacaactgaagaagaatagcgcactcgacaagaagagagaactaaacatgcaaccgggtcggagcgatcaagaggttgttatagaagagcctgaattgcatgaggatgatggtgtagaggaagaagaagaagaagacgaggtatccgaagaagaagagcccgtacacaatgaagaacttcttgatgatagtaaagatcaacaaaatgataaatccacgcgcagtgtggcaagcttgctgtcgagattccagtataaatccgcactagacgtaggagaacactccgactcttctgatatcgaagttgaccatacgaaaagcaccgatccttagtgttgttgctattattgctatgtaattactattcgatgcaatatgttatacatatacatacacgcaatgagaaccctaaccttgaacttactattttaaaaggacatctcgaaaaagcttagggataattaatattttgtaggttagagctgttatgtagggaagaaaaacaagggctttaaaataataatcacattacacgaataacttaatttgtctttctgaaatggaaaaagaaaaaaatgacgactgtaacattggatgaattaatactgtcattattgatacgttgttaattatagacagaaatgtattcagtacaatagaacagtgctcataatagtataaagggtcacaatgtccaaaaaacaggaatatattgcaccaataaaataccaaaacagcttgcctgtgccacaattacctcctaaacttctggtttaccccgagtctccggagacgaatgcagactcctcccaactaatcaattcactatacatcaaaacaaacgtcactaatctaattcaacaggatgaagatttaggtatgccggttgatttgatgaaattcccaggcctattgaacaaattagattctaaactgctttacggctttgataatgtgaaattggacaaagatgatcgaattttactgagggaccctagaatagatagactgaccaagactgatatatcaaaggttaccttcttgagacgcaccgaatatgtctccaatacaattgcagcccatgataacacatcgttgaaaaggaaaaggcgcttggatgatggagattcggatgatgaaaaccttgatgttaatcatataattagtagggtcgaaggaacattcaataagacggacaaatggcaacatccggtgaagaagggtgtcaagatggttaaaaaatgggacctattgcccgacacagcttcaatggaccaggtgtattttatcctaaaattcatgggcagtgcatcattggatactaaagaaaaaaaatctttaaatacaggaattttcaggccagtggaactggaagaagacgaatggatttccatgtatgccacagatcataaggactctgccattctggaaaacgaattggaaaagggtatggatgaaatggatgatgactctcatgaaggtaaaatatacaagtttaaaaggataagagactacgacatgaaacaagtggctgaaaagccaatgacagagttagctatacgtttgaatgataaggacggcatagcttactacaaacccctacgttcaaagatcgaattaagacgtaggagagtaaacgacatcattaaacctttggtgaaggagcacgatatagaccaacttaatgttactttgagaaaccctagcactaaggaagctaacataagggacaagttaagaatgaagtttgaccccataaatttcgccactgtagatgaagaagacgatgaagacgaggagcaaccagaagacgttaagaaagaatcggaaggcgattcaaaaacagaaggttctgagcaagaaggagaaaatgagaaggatgaagaaatcaaacaggaaaaagagaatgaacaagatgaagaaaataaacaagatgaaaaccgtgcagctgatacgcccgaaacttcagatgctgttcatactgaacaaaaaccagaggaagaaaaggaaactttacaagaagaatagaatattgagaagtgaagggagattgattttaaacctgtagttctttttacatttgtttggaaataaaaaaaccaaagtaaatattataaatatgtattaataaaatatgcattacctcaatgtagaagaaaaagatagtgagcacccaaacggaatccaaaatgcaaaatcgaaatgacacctaaaaattcaatgcttcttgatgattaatgcaccggtttgccagccaccagcagttacactgacacaaatataatcttcaggtagttctattttcgtgggcttaacgaccctaatgtttctttgcccttcccaattgccaatatgtagctcgttaactattttttcagaagggcccaatcctaagcacccacaatcctgactttcaataccccatgaatacaaatgaccgcgttcggttagtgccaccgtgtgatagtcaccacttgcaacggagataacattttcattgatgtctagctccgttaaactatctttatcgacatctccatttgttactttcaaagtataacagtgagtatcggtgaagaggactaatgaagcaaaacaggcgttaattttgcacagttttccgacaatatttaaatctactatctggttcagtccattgtggtacttccatagtttatcgccgttgttattaatgaagaaaacgcagttatcttgtaaacatgcaaagtcgacaatcctggagtctccattaacatcattcgtattcgggacaatctcgtattttgcaaaagcaaagctctcgcccttttgaatagcatctctttctttccatgcaaccaacccgaccttatatatatagcaacaattgaaattccaaccactagcaattttcaaaataggattcgtagcacgactaggtaggttagcaaactcaattttgacaccttggtcagattccgttgagtcccaagaataaatattgttatctgtatccattgctaggaaatgacttctcccagagcttaccgcgacaaattgaatatcattaaatgatcctaaattttcatccctaccactatataatgggaaagaatttcttgcgaacattctcctgatatgattatttcctggtacagccttgttagcacttcgttccagcatttctatctggctgtaaatattctcatgcggccccattgaaggcattgtagttctagggacaccactatggctccctccgggagaggctgcaggcgcacctccgctatctatggtaatatgctgagctgtagttgcatttcctggttcataagcagtagatggatggctaccgctcattctccttccagaaaatgtacccgtggtattgacagtactcccattactgcggctagtgatccgcggatacgatctttccatattgtgaatcatttctctgaagggattataatcatgctgtgaaccactgggacctggtccttttaaccctccagaaaaagtggatccgctgctgtaaaggttacctgactcagtcaatatttggaaagaaaaaccaccactagatacttgagctatgatttcgtctccatccttcttgatggcgcttaacgggtcctctgaaggagtgaagttactagttctagatgttgtcctactgttaaaccaaggaacttcagtgggggtattgacaccatatttgaaccgcggacttggcccgtttagtgaagtggcgacaagttcattattggaactcgcggtatagcccaaccttccatgctttaaataaccccaactataaaactttgcatcatatgcccgtaattggtatacttcctgccatgacaaggtggggaatgcttctcttaaaatcgtctctgtgcaggtcttaaattccgccgaatttcgaccctggaaaggctcgtcatttgtctttaatgtcccaaatgccttatgaaatagttcatgccacaaaattttagagtggtcaaaatctagtaatgtattataatacttatttgtctgcgagaggttcttaatatcatcactgcttaaaaatggtagcgtagcttgaacgatatctggggacaatcctgcgtcaggctccttttctctgctctcaacttcactcatgatgtgcttttccatttataattgagagtatatcctttggacaataaaactatactccaaaaaaggggttggagcttttatacgcctttatccattaatcatccgtttgctcaataaaagggtctcggcgaggcgcccggaagaatcatctagcaataccttcaaaataatacggacattaaatacaaattaactaattatcattaggtagaggcctacatatgcaaattgggtatatattaagcactttaaaatcaattgtttgtagttgtttataacctattgaatactttagacaaaatctcagtcaaattagaccaatttttgattctgagattttcgttggctaaatggccattgtcagtggattggccacatggtatttgaacagctggcgcgtcgaatattctttccaacattctcaaacatgaaatagaacctccttctcttactagcaatggttctacgtcccatgcagtagtaatttcgtcctttaatatttggtatgcatgatttgttgggtcacccaaccaaccttctgcttcgtttaaaactttaatttctagatgattttgagatttcaattgcttgaaactttcttctaaatacgctttgagatctctcttgacttgttctacactttgctcaggtactaacctgatggagatacccatggtgacactttttggaataactgttatgttaccaggaccgctaaacttgactgttgtcatagacaaggaaggcttagtccagttggtaattaaatcttgaacagtagtattttcgtcgatatttgcaagctcggtaattttctgaaacctttgatattcttcttcagtcagatctttcaatggtgaataaaaatttggaatcataatttcattttgttcgttttgtagtttggacacgattttcactaaattaaccataggttcatcataaacaccaccgttaagaccagaatgtccgtcaggcttatcgctccagacttttatttgggcattaataacacctctcaatccataattcaagcatggatgttcttgatcaacccaagtagaattacttaataaaatccagtcaatatcttttccaataatatcatggtacttttcacaaacttgcttcaaactagcagatccgatttcttcacttccttccaccaaaaatacgacatcgttcaccaattctccctgttgaaacaaatacgccacactatgaatagcgctcaccaatggccctttattatctgatactcctcgaccttttaagtatccgttttcacaagttaaagtaaatgggtcggtattccagttgaaagtatttccagacgatataacgtcataatgcccataccatagaatacgctttttcttggcacccttcacctgtgaaactttcccattcccttgaaaatatgcgaatacaacaggattaccaccatcaggcaatggaaataattgggagtttgtagctccaaacttcaagaataattgttgcaggtagattgcacaacgccttaatgacaaagtattagtagtgtctttgctttgagacactgtctggaaagaaataagttctctcagtgtgtttaacatctcctcgttatttagagaggcagattgataggcggcccataaattggtggtttgtaatgtagatgatgcattgatgggtgagttgcttgacagaggcaccgcagataataatgaggttatatcccagagagtcaatgacccatcgctaccacccgttaataaactaacagatccagcatttgatttactgaaaatctctgagcttaatatttttccttgttgagggttccaatggttaacttggttctggtaaaaatgcgtgatgcctgattcatcaatggcaaatacatggtccatataaactgatattgaaatgacgtccgattcatgctttgttttcagagttgagattatttgctgagtatttaagtcccagatttttataatcccgtcagtcaacccgcaatataaaaatgggaactcaatagtttgggatatgacgctatcttcattgtcgattttatcgtttatcaaggagattttaacagtgttttgccctttatctttagagaactcccaaagcttgcttattccatcaccagcggatgaaattatgtgctctgcaccagaagttcgtgagcttttttccaataactgattaaacctgggacacaatttattaatagaataaataaacccataatgtgcatatttaataatgttttcggagggaacctctatgatggcagcgccacagttttcttgtagagaggtcaatgaagtttgagataatgaatttgaactatatccagtcggacctaacgaatcaaagaacttatcatatcttctatgcggtaatttattgatattttctactccatcagaggattttttttcaatcttctgaatcaagttctcaacatatagtaagcttgcattttgacagccaaagacaatagtttccaacgaatccaaatatgccaatgagaaaatatcaccaatatcggtcactgagtaaacagtggctatttcagtaacaggtagaaagtcatctctaatggtcttttcgccaatggaccaaattctcaccaaagaatctgcgccgcctgaaaataaaaagttttcatcttctgatcctgtcaagcacaaaaccgaagatctggtatgcgtttcctcttgtgattcgcctagtctaatcgtatgtattagattatatgtgggaagatcaaaaaccaatatcttggagtcttggctaccagcaaacaacaatcttttttttggaaatgcaacaatggataagatggaaaaagcgtgattccacctatgaattagttcagagtgcaatgcgacacccctgctatcgtacatgatttcacaattacttctgccctcgtttttcacttttccttacagggttgttcggtttctcgaaatagtttttcacttaaataattcagttacacacattttattgatattggtgccacagcttttcgcggcgcacaatgcgattatcactcaagtttatggtaaagtcggtattccctctcatgagaaaaaaaaaaaaagataccatcttcattgaacttctaattgcagcagtaattgtgagcaatgctcaagagcttccttaccatataacaaaacatcgaaatcagaggatcattctagatcaaagtgaaatgcccttaactatgaaaaggaatacgaaaatagctgtgaagtgttattataattattaacaaggttagtaatctttaaacagagcctaatacttgcgggaaggactttcaatgttgcttcactgcagcttgttggcggctatttgatgatgattttcttgagatacataattattattatcacgtttcacggattatttttgaaaagctagaattaatacaaaagataggactattgaagtagtatacaccaatttttgcttaaaaaaactacgggaatcaaagattaccttgaaagtgaggacagcaaataactaaaatgaaaggctcacccatttctcaatttagtaagacctctattaatgctcttaccaggccttggaagaaatacagagatggtgaattattttatgggttatcaaaagttgggaataaaagagtgccgttgaccacgaagcaaggtaacaagacgatgtacaaagggacaagagcttcagggattggtagacatacaaaattcggtggttatgtgataaactggaagaaagtcagaacctatgttaccccagatatggttaatttcgaattaaagccctacgttaacgcaaatgtaccacctctaaaacacgaatttaaaggatttagcggcggcccattagatcctcgtttacagttattaaagataaaagaatacatagtaaacgggagggtacaaagcgaaggggccaccgacacttcatgttataaggagcgtggataagttatttataatctttcttcaatatgcgtgtaaatactagttttcgactttataggtagataaaaaataaaacttaagattgtaaaacaaaatcaaataaaacatggcttagacattgcaccatatgtcatctttctttgagttaaatatagatacatataaatctaaaagaagagcaaaaagttcgtacgtatataaatgcgcgtagcagagagaatttgatcttcttttttgttttccttcttttttttcttttctttgtttacatagcacctggaacacccaagacttgattcaaagcactttgaccgccactttgttggtattcaatggtaatgacttctagcaaagaaaacccaccagcaatgccaacaactataccagcagctttacctttcaaacccaaagattcaccgataacggtgatcaaacttaagacggatgcacccgtaacagctgcgattggaatgactttgttcaattctttagcgacattctgttctctgcgtcccatcaaagtgataccttggtctttgaattccaaggctacatcacgagcagaggaacctgaaatagcctgccacttatcagcaaaccaaataccagtaaccaatataaaggcggaataggtgatgaaggttaaaggttgttgagtgacacctttgaagaaagatgttggtggagccaaaagagataatgggaaggttgggactgctaaaagattattagcattctcatagtggcccattattttgcagatgatgtgagttggttcattcttggcaaccaattgaattaaaacgaaagcaaaaatgtggatgtagaacaagatggtgtaagaaaacaaaacagataaacagccagtgtatagtagcttaattgggtaaacattgtttgtaccacgggctcttgttgatctgattggcaattctacacggacactttgcaaatagcacacaataatggcaattgccaaaactataatagtagttgtcaagtttggtagatagtctctgttgaatgcagagatgatgccgccaataaatgtcttgtgcttagatcttaaaccttgaatcaaattgattagggcaccttgggcttcggtttggtcgtcctcgccaactttaatttgagaaacaccaaaagtatcagccaccaagttagtggcgattaccacagtgttgattatcatagctccagaagaaaatccaaatcctttatcgatgacttcagctaacaaagtggtgaatatgccagcaccgaccaattgaaagttgatcaacccgatctgtaccacagataaatcatcaccaaaataacctgcaaatatgaaaatgttggtcaaaatcacatactgaacaatggcaaaaacttttgttaagctttgaaataattctctatcactttggatcttgaaattaactttaattactttcaaaccggctaataattgtaagattaacccactagaaatgttgggaaaaaggccaaattctagcaaggttcttggttcacacccaaatacacctcttagaaaataaatggggtcattaacattaggtgtggtagctttgggcaaaccaacaagtgggaattgtgcaaaaaggtaaattaaccctgcaaaaatagtatagacaatcttgtcatcaaatggtaatttttcaaaaggtaactcaacttccggtaaaatcggtaggataggcttaacgatatcaattagacgaaaaccagacatactaaaacaatggagagtggcgggggcaaatgtgctaaaaaatgcgtacgagtaatggattcaattcaataaagctatgaaaaaccacccaacccaagcaaagaaaaaaaaaagagcaagcttttctgcagtgtattcgatcttacttttattaacttttactaattcaatgaaggaccaaatgacatctatcaagactgtggtagctagcgaacaaaggataactattttgtcggtgtaaaacaaaccctgcttccgctttgctctctacccgacattttttttttcactttttcagctcttttctttgccacgaaagcgtgtaaagtgatacagatcctaccgtgtctaatgatatcgttagcgcccctctacatggttgcattaagtacagacagaggaatgattaaacctaagacgaggatagtccttatgcattatgaaaagcaattcagggcagttgaagtcacatatatggctgcaaatcgaatataacttgtaatgtagttcaaagtggccggtagcaataaaaagaaaggtatctcaacaactttatgtttcacgttatgaaagaatatcgttaacagtctcaacagtgtctgttcttataatttggcatgagtgtatgatggttgttctctgttgtttcggtactatcaacggttattatcattggacgcaaaaatatcgttggcggctaaatacgggggtggcaaagagtttgcgcccgcgttcagtggatacaaacagtataagtaggacaggcgacatctttagtaaatagtacaggaaaaggaggacttatcagggtatcacacaaacaatggtacagaacaatgaatcggtttttttcgttgaatgcgactcttataaggagagcccttccacttcaccaatacgcttggacgacctggatggaaatgacgctgtgtcggatcagggtttagctttcgacggggacgtaggaattacatcacaagctcgagtaagaaatcctcgagctcaaatcttcgaggatagtaatactgacgtagtattgcatttggatgatcttgatatggtcccactaaatacgaagttcgatatgcagatggagatgggttcacccatggcgatgccggcagaaacgccacctcctgtcgaacctttaaaaacaaaagatctagcatattcatccttggctcaccttcctagctatttctttgagcaaacacatttccgcatagaccgcaaatgcctgttggaaatgtctaagttaaggcgaaattatctaactataagtaaacaagatgctttgtcatgtccgcagcttcattcaagagtggctgggggttatcttaaacctgtaaaagaaaaattatttggaatacgtcactttcttgatctagaggaaagtaatactgtaaacctcctccaggatggtaattatatgacggaattgttcaacagtcagattaatatccccacttttaaagaatttagggaagattttgaatggtgcttgaaaattataagagatagaagcctatcaaggtttagcgaaaaaagattacaatatcttgtaaataagtttccagtttttcaacacctacattccaaggaagaaatgagacagagcaaaaaggtgccacacaaggatttttacaactgtagaaagattgatctgaatcttctgttaagcggctgtttctcacagtggcaattgactgagtttatttggaccaagttgagaaaagaaccggacagggttatccatcaagcttttaatggtagtcatataaccttgagccaattattcaaagtgaatttcgaggagaccggtcagttcttcaatgggttgaaaattattgacgattcatttttggagtggtataaagttatttatctcgcaaaatatcatttggttaacgatgaaatggaaatacacacaggctcacacggtaagcagcttcgatactatttgattgcgaaaacatttttggagtttgataactatattaatggtgaatacttagcggaactactgaaaacgtttttaataaaaccgcaagaggagtcgaaatatcagttatgtcaactctccgtggacttccaattttatctgcattacgataattccgatgtggacaattggtggatggtctttgccaattggctgaaccactataatatattttctaacaatattcgctggaatattcgcatttctagaatttatccagaactgtatcatactggcaaggtgaagaattttcaggagtatttaaatctaatcttcaaaccacttttcaatgccgaaaattatctacacaagtcattaggacctattcttttgaaatttctttctcaagtatcttcgattgatctatgtattcaagatacggacaactatatttggaaaaacttcacagcagttagttgcttgccaaaagattggacatctggcggtgataatccaaccatttcacaatatatgtattacgtctacgtcaacctaacaaaattgaaccatatccgccaagcccttcatcaaaataccttcactttgagaagttcatgttctcccacctcaatgaatcgaacttcacagtttagtaatacactgaacttcacagaacatacggaagctattttaaacaatttcttgctcgcctgtggagggtttctaaatgcagaaaatctctggaatgcaccaccatcactggtgtatcttttctatctaagtcaaattcccatggttgtggcgcctttgaattccatagtagattcaaagcctacaatgctgcaagaacaagccccgacggggcttgtcctagagccctcaaagccttataagaagaaccctttcatgaagttttttgaaatggggttcaagatatcgctgagctcagaatctatcctctacaacaattcgtatacgaaagaacccattatagaagagtatagtgtagcggctagtatataccgtttacattcagcagatttatgcgaacttctaagaaacagtgtcataaccagtggattttcaagtaccctaaagaacaaatggctcggcgtttccttagccagccatgactacttcgtggaaaacactgggtttgtagacaagtggtatgattgtaaaccaaatacaagtttagagcataacgttccgatcatcagacgtcaatatcgcagtagcactctcgcaggggagtggcgactcataattgcgtgaattcgctcatgtttcttcgaggggcgcatattgtgacgctaatattatgtaccgcccttccccacacacacaaaaaaaaaaggttaaggataaagataagtaaactaatggaatatataaacaaataagtaagtagatactgtaaatagaacacacgttttttaatttatttttttttttacatatcttaatttaatataaatcaaaaagcccaagcctcaaacaagagtcttatcactccatttataacataacaattcgaaatctctaagctcgcttatagttgacaatgaccatattttctaggttctcatattttgatagtctattctcctttaaaaagcaagagccttcccccattgaaataatctattgcaatgaaaacaatggtttcataaacataaaatccttagaaagccccactgacgatagcatggaggcggacatttcacatagagaaatggctacaatcctgactagaaacagaaacaatttgggtaaggttgccattgataagaaaggcgttaataatcattgcatagatttgaatgagctgaaaaagggccttgtcgccaatgaacacaaattggataacgataactcaacacggcaccagaacacatattcaccagaggattccgtggaatttgataggttcgatgataaacaaagcagaatactaaagtgtagcactagaaggagctacttgagatacaagaaataagacaattgagctgcttcattatatatcttgatataatcacctttcttatcgtcagaaagagtgttctctatgtttttctgcttccataaatatatagttcaaaaagtaatatcatatactattaataataaaagttatactgaatatattgattagttctattaattactattgacacactttgaattcccttaaattaaccctcaggaagaaggggtccttaggaaaatttttcttttttcaatataaaagcgaggaacaatggatgggaacaaaaccatgttcagcctttcaacaattggtagaagaagccaaaaaaaaaaaaaaaacagaaacgccaaccatgcacttttctttgaagcaattggctgtcgctgcgttttacgctaccaatttaggctctgcctatgtcattcctcaattcttccaggaagcctttcaacaagaagagccaattgagaattatcttccgcaattaaacgacgatgatagctctgccgttgctgccaacattccgaagccacatattccttacttcatgaaaccacatgtagaaagtgaaaaattgcaagataaaatcaaagttgacgatttgaatgctactgcttgggacctctaccgtttagctaactattctactcctgactacggtcaccctacccgtgtgatcgggtccaagggtcataacaagactatggaatacatattgaatgttttcgatgacatgcaggactactatgatgtttctttgcaagagttcgaagctttatccggtaagatcatctctttcaacctctctgacgccgaaaccggtaaaagctttgctaacactacagctttcgcactttctccacctgtggacgggttcgtaggtaagctagtcgaaattcctaacttgggatgtgaagagaaggattacgcctctgtagtcccaccaagacacaacgaaaagcaaattgcccttatcgaaagaggtaagtgtccttttggcgataagagtaatttggccggtaagttcggtttcaccgctgtggtcatttacgacaacgaacctaaatctaaagaaggactacacggtacattaggcgaacctaccaagcacactgtcgccaccgtcggtgttccatataaagttggtaaaaaattgattgccaatattgcattgaacatcgattattcattatattttgccatggactcttatgtagaatttatcaagacccagaacatcattgccgacacaaaacacggtgatcctgataatattgttgcccttggtgctcattcagactctgttgaggagggcccaggtatcaacgacgatggttccggtactatttccctattgaacgtcgctaagcaattgacccatttcaagatcaataacaaggtccgttttgcatggtgggctgctgaagaagaaggtttgctaggctctaacttctacgcttataacttgaccaaagaagaaaactccaagatcagagtatttatggactatgacatgatggcttctccaaactatgaatacgaaatttatgatgcgaacaacaaggagaaccctaaggggtctgaagagttgaaaaacctgtacgtagactactacaaggctcatcacttgaactacactttggtcccatttgacggtagatccgattatgtcgggtttatcaacaacggaattccagccggtggtattgccactggtgccgaaaagaataacgtcaacaacggaaaggtcttagacagatgctaccatcaattatgtgatgatgtctctaacttatcctgggacgcattcattaccaacaccaagttgattgctcactctgtggccacctatgctgactctttcgagggtttcccaaaaagagaaacccaaaagcacaaagaggtggacatattgaatgctcaacaaccacaatttaagtacagggccgacttcttgattatttaagtgtactgttcacatcaagtatttctgtataattatctaaaagaaaataaaaaccctcttttttttaactgcacgtgcatcaaggggatcacagcctccttatcaaagtgaaaaaaaggtagaaaaaaaaactgaaattgtgatataaaagtttaaacaggaaattattgtaaattgaacaatatgtgtgaagcccgtttttggtttgttattcccaactaaccataccctcatagattactctgcatttctactatatggttgaaacatttagttttgctcatttggcttatttggtctttgagtccgttttacaggtagtcattatcgcactcgctggtttttggagcgctagttctggtctgctgcccaaacaaagtcaaaaaatcatttctctgttgaacgtggacctttttacaccatgtcttatttttagtaagttggccaaatccctgtccatggccaaaatctttgaaatagccatcattcctattttttttggtttgactactggtatttcatttatttccggaaagataatgagccgtatcctagacttggataaagatgaaactaattttgtggtggcaaactctgtctttggtaacagtaactctctacctgtgtccttgacattatctttggcttacactctgcccaacttaacttgggaccaaattcctaatgataacagagataacgttgcatcaaggggtattttatacttgctgatctttcaacaaatcggacaaatgctgaggtggagctggggttacaataagctaatgaagtggtctggagagaacactcagcatatgccaccttctcaagtgcaatctttgttggaaaggacgcccaacattgataacgaggaacttgtcaatgaggaacaagaggaacaagaattgcttgaagaagaaaataacagaatgaactcatcttttttgagttcgagttccatcggtgataagatttggcaaaaatcatgcactgtatttgagagaatcagagcgaaccttaatcctccgttatattccatgatttttgctgttgttgtggcagcaattggtccgttgcagagagagctatttatggaagatgggtttatcaataacacatttgccgaggctgttacgcagctgggttcagtttctatcccactgatcctggttgtcctcggttctaacttatatccttctgcggaagtcttccctaagacggttcaccatagcaagttattgatcggctccatcatcggaagaatgattttaccttcttgcttccttttgcctattattgctattgctgttaagtacataaacgtgagtattttggacgatccaattttccttgttgtcggttttcttttgactgtttcccctcctgccattcaattaactcaaatcactcaactgaatgaatttttcgaggcagaaatggccgatattctattttgggggtacgctgtcttaagtttgcctgtaagtattattgttgtctcaggtgcaatttacgttttacagtgggctaacccaacttaatacaacttttcattcctttgtatagagtcttcatgaatgaaagtcttattcatttttttttttttttagcatagttttatattccttttttattccaagacttatattctcattatattctatttagtttcgcatggaatttcaagtacacatataactacagccttacttgaaaattgcctgtctgggtcttatactttgcacccttgtacagctttgtatttttgccaattgttaatccagatacaatatcgatggcttctacatagattccactggccgattgtcctatgtaagaatattctaaggagactgtttgtaaatcaactttttttgtaaaatttggcccagtattttcatactcaatacagccacgtagtacaggtaccgttccagtggcagttgatttatcaaaaatccattgtccttgacccatgataatgctattttcaaaacggccatgagtattgcgcaatatttttatcttatatgctatttcatttggatcagcattctcaacattgaactgtaaatctatttttaggtcatcaacttgtgaaacttttttgaaattttcaatatttaaggataactcaaattcatcagaatctttacccaatccattttggaagtgtaaagacatcaagccaatagaattcatccttactccggattgctttacttgagaacttaaatcgacggaatactccagcaatctgaacttcccatctggtggtataaacgttatattagagggagaaaacacaccatcattgatttcaacacagtcatgcaaactgggtatacctatatcatttcccatagtgtttaattttactgcaactagaggattatcattcaaataagatctcacgtccactattccatggatacttccagtgagcaaccttagatgtgattttttcttttcaaatacaacatggaatgtttctaacaaatccacataaagctcattattctcatgtttgctagcccttgaagttctccagggaacaatctcttcattttcgattagtgaattactaccacgagaaatctgattttgttgtagctgctgttgcctttgttgtgggagttgcacagcctgctgtaaattatgggctgtagaacttatgaacttcgataaatccgatctttcaggaacagcttctttaattttattaacatagagcatatcactcacatttggttcacccgcttcgacgcaacagttaaaaatcaaactgattctatcataattattaacaattttcttgatacttaatttatccttgtcaaaatattctaacaggatacgatctatagtctctaaaaaggtaaaacaatcaagcgggccttttgacttcgaagtggaggctaagcaccaataattgagcttatttataactgagaaatacttatagacctctaaatctcttccaaccattgaatggtctaaataatcatcactactgctatcttcgagcaattgaggacatgtggtacgaacgcgggtccacaggtgcttgaaggagggagctgttgcacctaaaagatactggaaaataagtttgttctttgtatcagtgatatagaatgacaaatacatctattttggttgggttggtaaggtttacagcctctgttgttgcccaagtcctgttatcgccaactttaaataaatctcttcttgttctttgaccaaaaatttcatttttcgtcgcatttaaaagaaactgaaatttcaaacataaacaccaaaacaaagcatcatcaagggaacatatagtaaagaactacacaaaagcaacaatgaataatcagccgcagggtaccaacagcgttccaaatagtattggaaatatatttagcaacattggaactccatcttttaacatggcgcaaattccgcaacagctgtatcagagcctcacaccacaacaattgcagatgattcagcaacgacaccaacagttactgaggagtcgtctacaacaacaacaacaacaacaacaacaaacttcaccgccaccgcaaacgcatcaatctccaccccctcctccgcaacaatctcaacccattgctaatcaatcagcgacttctacccctcctcctcctccagcaccacacaacttacatccccaaattggtcaagtgcccttagctccagcgcctattaatttgcctccacaaattgctcagttacctttggctacacagcaacaagttttgaacaagttgaggcagcaggccatagcaaaaaataatccacaggttgtgaatgcaattactgttgcacaacaacaagtgcaacgccaaattgagcagcaaaagggacagcaaacggcacaaactcagctagaacagcagaggcaattgctggttcagcagcaacagcagcagcaacttagaaaccaaatacagcgacaacagcaacaacagtttaggcatcatgtgcaaatacaacagcagcaacaaaagcaacaacaacagcagcagcagcatcagcaacaacaacaacaacaacagcaacagcagcaacagcaacagcaacagcagcagcaacaacaacagcaacaacaacaacaacagcagcagcagcagcagcagcagcaaggacaaataccgcaatctcagcaagttcctcaagttagatccatgagtggacaacctcccaccaatgttcagcccactattggccaacttcctcaacttccaaaattaaacttacccaagtaccaaactattcaatacgatccaccagaaaccaagctaccatatccaacctattggtcagacaaaaaagcagatacggatactttgttgtacgaacaaattatccagcgtgataaaattaacaaatattcgctaataagagaaaccaatggttacgatccgtttagcatttatggatttagtaataaagagtatattagtagactgtggcatacactgaagtattatcaagatttgaagaacactagaatgaaatctatcacaagcacttctcagaagattccttcggcaagtatttggggaaatggttactcagggtatggtaatgggattacgaatacaactaccagagttattccacaagtagaagttggaaataggaagcattacctagaggataaattaaaagtctataaacaggccatgaatgagacatcggaacagttagttcccataagattggagttcgatcaagatcgtgacagattcttcctcagggacactttgttatggaacaaaaatgacaagcttattaaaattgaagactttgtggacgacatgttgcgagattaccgatttgaggacgctacgagagagcaacacattgatactatttgtcaatctatacaagagcagattcaggagtttcaaggaaatccatatatagagttgaatcaggaccgtctaggcggtgatgacttgagaattagaatcaagctggatattgtcgtgggacaaaaccagttaatcgatcaatttgagtgggagatctctaatagtgataactgtccagaagagtttgcagagtccatgtgtcaagaattagaactaccaggtgagtttgtgactgccattgctcactccataagagagcaagttcatatgtatcataaatcactggcactgttaggttacaattttgatggatcagcgatagaagatgatgacattagaagcagaatgctcccaacgattactcttgatgatgtttataggcctgcagcggaaagcaaaatttttactccaaacctattacagatttcagctgcagagttagagagattggataaagataaggacagagacacaagaaggaaaagaagacaaggtagatctaatagacgtggtatgctcgcattgtccggcacatctgcaagtaatacatctatgaacggcgttcacaacacagtagcagcaggaaatgcttcatcgttgccaccaggagagattttactgccagatattgcagatattccaagaactttcaggactccagtacctagcactttaatgcctggtggtgttgacgtaggcccttctgtggaatcgtacgaattgagaaacacaaccacttataaaagcaggccagatagacctaagccagtttcacctccttgttatattattgaccatattccgggtcattcgctactactttctattaaactgcctgggaaagttaatacaaaagaagagttcgcagcagcgcccaatgacacaagtagtggcaccaatgcaatgcttccgagtccagaatcgctgaaaactaagctgaatagtaacattcgcgctggtgtgacgataccttcaatcccaaacccgattgccaatcacactgttactaattcacccaatcccacactgcagccagtaatcccaggtggggcagctagtaaatcggtacctacacctagtcttcctatagcacctccagtagcaccacatgatagcgaagcgacattgttgactaatagcaataatggtagcagtaacaataacacacagaatacatagaaaatatatacacatatataaaatataccggagatgtaaataaccgtggaagaatttgtattatcatcgtgttatacgatgcggagtccctttgcgcctactttttttagaagaatagtacataacctttataaaaatcttccaatttagatacataaaaagagcatgagaataacaagaacacgtagtctaggaaactaagcgctatgccagagcaagaactacttatagggcaagaaatgaatacacttcatgcaggttcatctactgatggcataaatgtcggaaacgcaggacgaactagagacacacaaactggcgtagaaggggaaacggaaatagggtctgacgaggaagatagcatagaggacgagggaagcagcagtggaggaaatagtacgacagaaagactagtaccacaccagctgagggaacaagcagccagacatataggaaaaataggaagacattttaatattcttgatagactttttaagaaacgtacacaacagtcttcggatatacaacaaggtgccatgtttgatggtgtctttagcaatttaagcgcaaaaccagataccacagagactgaaggtaataacgaacaagacataccacctacatacgacgaagctgctgctgatatggccccctcgtattatggaatggatttgaacaattcagatatctactacgacgaaatatgcattgaggggcttcctgtaggaaatatagcaaatttattatggaatatcatcgtaagcacgagttttcagttcattggatttttaataacctacattttacacacatctcacgcagcaaagcaaggttcaaggtttggattagggttaacgttcattggatatggttattcaatgattcccaatgatgttacttcaaaagtcggcaaaaataaaagcttaaatagaatggaattagaggatccaaatgaattcgatgatgttcgtctaaattcacaatcaacgacacaagataaatttgaatcacatttgaatcacggtctggatgaagaaaaacaaaacataccatggttggctgtttttgtggcatttcttgggctatttatcaccctgaagagtatatacgactacattcaagtcaaaaaattggaaaagaaatacctcaaccaaagtcaaaatcaagcataagccatcttcttcattatgataaaaagagatatataacttttttaagtgatcggctggtaaatagacttataacgagtagaaaacattagatgatatattgtacacaataatacatttcaggctagcataactaagaccttttcatagatagtgaaaacaataccaccactcaagaccaatctcccaagtctaggcgtagcacctttccaaaacgtctttaacccttcttctttgaaaatggttgcaaaacaattcattgtagaggagtatttggtggaatccaaactttgcattcttgttttcacagtatcaaggggcatggtggaatagaccgtcacaataccactaaatgcacccactaagaaggttaacccggatgataaaggtttgtcttttggcgaatccgtataatcttggatcaaggtcttaatcttattgtaacaacccaatctaacggcttggtttgcggcctgtctcatggaaactggcaaaacaccacgataaagaccagaaaatcctttatcacggactaatgatgaatagtttcgtactacaccgcgcccattattatggtattttggtgtagcagattgtttatcatcgatcaaagcagttttgattgcttcaaaaggagtcactgcggcaacactttctaatagtcccgcacctaacccagctatcacccctcttgtaccacttagttctccagtttcactatctcttagcatgtctttaatggtatcaaagccaagaaatctaatacccgccttagcggtgtttccaataataaatgcgggacatccgacataaatggaaccaatgccctgagtttttgcagttttatatatcaataccagaggatttcttgatgccttggaggccttatcaatcagctgcagccttgttttggcaaactcaaaaggatatgttatacatgcttcagcagcaccggctagggaccctgccagaaacgagtgcaatggatctacgtcacttttggtagctttactggacatcggtaaaatgctaatttataattcaagctctactttggagttctttcattgtgacatcaaaatgtttttaattttacgttggcttcgacattttacgttttatatatcacgctaaagtgagactaaatttcattgttcttcttttttttttttttcacttctaataattgaaaattccgcaggaattcttccatattcttgactcttcagtaagactaacttaatggaaatagagaaaatagtacatatttgaaaaaaaaaaaagaggtgttgaaatgatttgagaatattaaatagcttacaagcgttagccgagttcccagacagcagagtttctaccctgtgctctttgttggcggctttattgatgaggaatataaaaatgtaattaggcaaacctacgcgcgaaaatataagaagcaaagatataaagtgtagtatatttgaatatttacatgaacgaaacggcgacgtataatggtaatcggctgggaacttcattaaaaagtcaagatgtaagttacctcttagtaagaagagttattgcagcaagcttagtatcaatagggagactctgtcatgtaaaaaaataaatgaacacaatcataacctcttcgactgggctattcgttgtatagtatatgtggtggagtgtaatgaatgaagttctcagaagcttgaaagcatatcaaaatcacgtattgactatgacagattcttgtttcttgctccattactccattcgagtttttcacaacttttgtcgttcgtctataacatctcttttttttcccactcttctaaaatattggcatagctgacatgtttggaaccgaataagcaattacaatacgacagtaaaataaaagcatgttattgctgcttgtagagaattcctgcatatgtaactttctcattccgacgggataagttcataaactaatcagcgatgagttgcggaaaattcgtcaatagaatattttccagtcagtggtggtcccagtggcctgcaacctaatggctatagttctggataataaattgggcaaaggtcagtataaagaatgaatgtatcaggccgtaattgaagctttcaagtccaggtgaaaggccaaatcgacaattagcgaaaacaggatttttttaccaacttgaaatagtgactgctgtctttttgcctgattaagtggttatatatttcaactaatatcacaacaaaaggcctctcaaaatttgtggcgaagtgtacatcctgggtgctcaggtaagcgtcgtcttcgtattttttttttttcaacagtagtttggaaataatgctcttcgaggaatgcgagcggaaatgttatccactgtataagtcgatattttaagggacgctaaatatatcatcatagctcgtctattggtggcttctccaattgcactttcaatgcattatggtaaagtgtggtgataaggcatagtgatgtttacagaggtctgttggtttctctgggctcgctcatcatccgaccagtaaccttgtggggtttcacatattgttctatgcattattatcacggatttgtgcctgcaaatgctgtttctttggcttttctttctaaaaaaattatgatatatatattgttcctccttgtttaacaggctttacggtattgtggatcctagtaataggcgtacttttcttcatttacatatttgaacaatatatgtctcacaagtagttgaccgaatagcgttacgtaagggtcaaaaaccttttcagaattgtatatatgacatttttagaacatgatataataaacagaatataaaagaaaatagagacgacgtaccatggcatgaagaattgtactgatatcacattgtgttgagcactgatagattaatactatatttctgctaggtgcggggggtaacatgtcctaatgtgtggcaaccacattctaaggctcggtaagtgatgcgatatatgtgcatgtgtggctttcttcctaatttgctattagatgattgtgtgcaaatccacagaaatatacaatttcgagaatatatatactagttatcgttataagaacacacagtattggccaattcttgcctctgaatggtacaaaatgctttaaaatgtagtaaatgaaacattaattccaaatcagatttttttctgcaatgcttaaatctagtaaacacaagtactaccgaaaagcaaggatggaaactatggcagtattgaagagactgaaattccttctgtcgactacagtgaagacttagatgaggacttggacaaaggcgaagatatagcgctttcaagaatcccaaattgatggattattgaagctactcttttttctaatgtctttttgtccggttttgacggaaccgttacagcttcgacgtaccaaacgattggtaacgaatttaatcagatgagtatttcaaattggatcaccactgcgtatttaattacatcaacatcttttcaacctctttatgggtcattttctgatgcacttggtcgaagaaactgccttttctttgctaatggggcttttaccattggatgtctagcctgtggtttctcgaaaaacatctacatgcttagttttatgagagcattgacaggcataggaggtggtggcttgatcacactttctacaatcgtaaattcagacgttattccaagttcgaaaagaggaatttttcaagcgtttcagaatttacttttgggatttggtgccatatgtggagcgtctttcggtggcacaatagcgtcgagcattggttggaggtggtgttttctcatccaagtacccatatctgtgattagttccatattaatgaattattatgtacctaatcagaaagaatataatcgtcaaaattctagcatattccaaaatcccggaaaaatactcagggacatagatgttatgggctcaattcttattataactggtctcacactacagcttctttacctgagcctggggtgttctacttctaaattatcatggaccagcccttctgtgctactgctattagttgggagtgtaataatcctcttactgttcatattgcacgaaaggaaaacaagtgctagagcgattattcctatggagctggtcaattcctcctacagtgtcgttgtactttcgataagtatacttgttggttttgccagctacgcgtatctttttactttaccattattctttcagattgtacttggagattccactgcaaaagcaggattacgtcttacgattccttccctatttactccggtaggcagtctcataacaggattttccatgagcaagtacaactgtctaagattattactctacattggtatttctttgatgtttttgggtaactttttattcctgtttattgaaaaaacttctccgaactggttgattggtctatttttgatacctgcaaatctaggacaaggtatcacttttcctacgaccttgtttactttcatatttatgttctctaagagtgaccaagctactgcgacatcaactttatatttattccgtagtattggatctgtatggggtgttgcaatttcagctggcgtcattcaattatctttcgcaggtttattgcgtagtaatttgaaaggtctactggatgaaaacaagataaagaaacttattgttcagcttagtgcaaactcctcatatattggatctttacatggcgaagttaaaaacacagtcataaagagttttgatgaggcaacaaagagggctcatctaatgtctacattactctcttcattggccctgatactctgcatccttaaagacaatctggcgaaacctaaaacaagaagataaacaatatatacctatgcccttgaccgactcaattgatacattaacagtattgaaactagatattctacttgacactaaactttttttgtatttcgtggaattgcaacgtttctaattgaccgacagtgctgaactgtgagcgaatgcaactatctctatagtttttttatcctctgtaaactttaactaaatacatactactttcataatctgtgaataagatgtggctgtgataacctaaaatagtcacaaaccaatgaaaaaaggcttcagaaaacttgctgtaaagtccccccacttttttgtgttaccgccacctcgagtgcactttttttaataaagatctcgtgtaattgtccaaatctgactttttcttatagtctcgctggaaccacagtgcggctttgcaattttgcaaatcggaatttgagtcacagatcccagaaaaactccacaccttccccacgcagcaagcgataacgaacaagttgtcaaattagacccataataattttgaacacttctacctgttcatgtcttttctcgaacactgtcatttgaaattatgcactgtgaaaaaaagaaacaaagaccaaaagaataatataaatagtgaagtaaaatgtgttgtaatgcacatggatcttgtactgctcaaacttaatatttctattgtagaaaaattttcgatttaaaattgtgaaaccgattatataaaagtatattagctgacattaacgtctcaaaaccaggtcaatagctttaaaaataaaaataaatccctgcagaatactcggaaagaatatgtcacgtaagagctcgactgaatatgtgcataatcaggaggatgctgatatcgaagtatttgaatcagaataccgcacatatagggaatctgaggcggcagaaaacagagacggacttcacaatggtgatgaggaaaattggaaggttaatagtagtaagcagaaatttggggtaacgaaaaatgagctatcagatgtcctgtacgattccattccagcgtatgaagagagcacagtcactttgaaggagtactatgatcattctatcaaaaacaatctaactgcgaaatcggcaggaagttacctcgtatctctttttcctattataaaatggtttcctcattataactttacgtggggctatgctgatttagtggcaggaattacagttggctgcgtactcgtgccccaatctatgtcatacgcacaaatcgctagtttatctcctgaatatggtttgtattcctcctttattggtgcgtttatatattctttgtttgccacatcgaaagatgtttgtattggtccggtcgctgtaatgtcactacaaactgccaaagtcattgctgaagttctaaaaaaatatcccgaagaccagacagaagttacagctcctatcattgcaactaccctttgtttgctttgtgggattgtcgccactgggttgggtatactgcgtttaggctttttagtggaacttatttctctaaatgctgttgctggcttcatgaccggttccgcatttaacatcatctggggtcaaattccggctctcatgggatacaactcattagtgaataccagagaagcaacgtataaggttgtaattaacactctgaaacatttaccaaacacaaagttagacgccgtttttggcttgattccgttggtaatcctctatgtatggaaatggtggtgtggtacatttggtataactttggcagatagatattatcgaaatcaaccaaaggtagcaaatagactgaaatccttctatttctatgcacaagctatgagaaatgccgtcgtcatagtagtttttactgccatatcgtggagcataacaagaaacaaatcttcaaaagaccgtccaatcagtattctgggtacagttccctcgggcttaaatgaggtgggagttatgaaaatcccagacggtctgctatctaatatgagttcagaaatacctgcttcaattatcgttctggtgttagaacacatcgctatttcaaaatcctttggtagaattaacgactacaaggttgtccctgaccaagaacttattgcgattggtgtgacaaatttgatagggacattttttcactcatatccagcaactgggtcattttccagatctgctttgaaagcaaaatgtaacgtgcgcactccgttttctggggtattcactggcggttgcgttctattagcactttattgtttaactgacgccttctttttcattcctaaagcgacactatcggcggttattattcatgctgtttctgatttgctgacttcttacaaaaccacctggaccttctggaagaccaacccgttagattgtatctcatttatcgttacagtgttcatcacagtattttcatccattgaaaatggtatatattttgcaatgtgttggtcatgtgcaatgttactattgaaacaggctttccctgctggtaaattccttggtcgtgttgaggtggcagaagtattgaacccaacagtacaagaggatattgatgctgtgatatcatctaatgaattacctaatgaactgaataaacaggttaagtctactgttgaggttttaccagccccagagtataagtttagcgtaaagtgggttccgttcgatcatggatactcaagagaattgaatatcaataccacagttcggcctcctccaccaggtgtcatagtctatcgtttgggtgatagctttacttacgtgaactgctcaaggcattatgacattatatttgatcgtattaaggaagaaacaaggcgaggccaacttataaccttaaggaaaaagtcagaccgtccatggaatgatcctggtgaatggaaaatgccagattctttgaaatcactatttaaatttaaacgtcattcagcaacaacgaatagtgacctaccgatatcgaatggaagcagtaacggagaaacatatgaaaagccgctactgaaagtcgtctgcctggatttttcccaagttgctcaagtggattcaaccgctgttcaaagcctggttgatctgagaaaagctgtgaataggtatgcggatagacaagtcgaattccattttgccggaattatatctccatggatcaaaagaagtcttttgagtgttaaattcggaactacaaatgaggaatatagtgacgactctattatcgctggccattctagttttcacgttgcaaaagttttgaaggatgatgtggattatactgatgaagacagccgtataagcacatcttacagtaactatgaaacattatgtgctgtaactgggacaaatttaccgttttttcatatcgatatacccgatttttctaaatgggacgtttagtgtagtagatagtaagtactttaattaccccccctgtttttagttatacatgaaaagataattgtgttattaatgtagattaccatcaaatagctggaatatttattattttgagtatgttgaatggcgaaagtaaaaataaattttataatttcctgaaagcattagtacacgaaaagggccgttttcagtagtttaaggcgctgaaaagacatggtctagaagttaacttgagcttgagcctattttctacaaatgtcctttgaaaatacaaaaataaaaataaaaatgcatttaagtattaagcttatgctagatagagcaacattttcctaattttttttgaatttatttcatggtttttaggcggaaagagtttggacggcttgtctctcctaatgtggaagaaattatgttttgttatgaatctgaaaagaaaaatactattttagcaatacaatgaatttaaaaagttaccctgtactttaatccttcaattaaaacacttcttaaaatagtatattttgaagatcatcgatatatatacagaggcagttttgcaaggcagataacgttattgagttgtatgtaggctgtgtgattttaatctcataaatcaataatggaataattttcttattgttaatatcgatttatattttccaacaatacaatgaagtaagtactatttctatttggaaggaattcattccccattttagctcctcgagcggatgaatccatcactgttttgaagaaaaccaacaaagtgtcaaatagttgtctttttgaaattggttctgaagagttttcggaaaatgatctgataacaggcctttctaaaaatataaggttgaacgaatgtatgggttaggtaatcaaaatttaggcgccaacaaggaatttttctttaaaatcgcatgaaaagcctacacttggcataaataaggtgcaattataaatataaaagcaagatattttcgagatgcttccaggatttatacaatgaaagagcccaaagctgctgataacgatgaagccggaaaaactcttctccggtttaggtaccagcgatggcgagtatggagtggtaaatagcgagaacatatcaatagatgctatgcaagataatagaggcgagtgtcatcgtagatccatagaaatgcatgctaatgacaatctgggattggtctcccagcgagactgtaccaatcggcccaaaattactcctcaggaatgtttgagtgagactgagcagatatgccatcatggcgagaataggactaaggctgggttagatgtagacgatgctgaaaccggtggtgatcacaccaatgaatcccgtgtagatgaatgttgtgctgagaaagtgaacgacactgagactggcttggatgtggacagctgttgcggcgatgctcaaacaggtggtgaccacaccaatgaatcctgtgttgatggatgctgcgttagagattcttcagtgatggtcgaggaagttacaggcagctgcgaagctgtatcttctaaagaacaattgctgaccagctttgaagttgttccaagcaaatctgaaggtctgcaatctattcatgatattagagagacaactcgctgcaataccaattccaaccaacacacagggaagggtaggctttgcatcgaatcaagtgactctacactcaagaaaagaagttgtaaagttagcagacagaaaattgaggtttccagtaagcctgagtgctgcaacatttcatgtgttgagcggattgcatctcgtagctgtgaaaagaggacttttaaaggtagcaccaatgttggaatttctgggagtagctctaccgacagtttaagcgagaagttcttcagcgaacagtactctagaatgtacaatcgttactcctcaattttgaaaaatttaggttgtatctgtaactatttgcgtactttgggaaaagaatcttgttgtctcccaaaggtgcgtttttgtagcggggagggtgcttctaaaaagacaaaatactcctaccgcaacagttctggatgtttaacaaagaaaaagacccatggagacaaagaaaggttgagcaatgacaatggccatgctgattttgtttgttctaaaagttgttgcactaaaatgaaggattgtgctgttacctcaactatttctggaacctcttcgagtgaaatttcaagaatcgtatcaatggaaccaattgaaaatcatcttaatcttgaggcaggatctaccggtaccgagcacattgttcttagtgtttcaggaatgtcctgtactggttgtgaatcaaaacttaagaaatcatttggcgcgctcaaatgtgttcacggtttgaagaccagtttaatattatcgcaagctgaatttaatctggatcttgctcagggatctgtcaaggatgttatcaagcacttgagcaaaactactgaattcaagtacgaacagatttcaaatcatggttcaactatagatgttgttgttccttatgcagcaaaagattttattaatgaggaatggccacaaggtgtcacagagctgaaaattgttgagagaaatatcattcgtatttactttgacccaaaggttataggtgccagagatcttgtcaatgaaggatggagcgtgcctgttagtattgctccattcagttgtcatccaaccattgaagtgggaaggaagcatttagttcgtgtaggctgcacgaccgctttatccataatattgacgatcccgattctcgtgatggcttgggctccacagcttcgtgaaaaaatttccactatctccgcgtcaatggtgctagcaactattattcaatttgttattgcaggaccgttttacttaaatgccttgaagagtttgatattttccaggctcattgaaatggatctactaatagttttaagcactagcgctgcctacatattttcgattgtatcatttggatatttcgttgttggacgcccgttatctacggagcagttttttgaaaccagctctttgcttgtaactctcatcatggttggtcgctttgtgagtgaactagctagacatagggctgtaaagtcaatatcagtacgttccttacaggcctcttctgctattctggtggataaaactggtaaagagacggaaattaatattagacttctccaatatggcgatatttttaaggttttacctgattcaagaatcccaactgatggaacagtcatttctgggtcttctgaagtcgacgaagcgttaatcacaggtgaatctatgccagtcccgaaaaagtgtcaatcaattgttgttgcaggatcggtgaatggcactggtactttgtttgtgaagctgagcaagcttccagggaacaatactattagtaccatagccacgatggttgatgaagcaaaattaactaagccaaagatccaaaatatcgctgataaaattgcaagttatttcgtgccaactatcattggaatcactgtcgtcaccttttgcgtttggatagcggttggaatccgtgtggaaaagcaatcccgctccgatgccgtaattcaggccattatatatgccattacggtacttatcgtttcgtgtccctgcgtgattggacttgccgttcctatcgtatttgttattgcaagtggcgtcgctgcgaaaagaggggtaatcttcaaatcagcagagagtatagaagttgctcacaacacttcgcatgttgtcttcgataaaacgggtaccctaactgaaggaaaacttactgtagtacatgaaactgttaggggtgatcgtcataattctcaatctttgttgcttggattaactgaaggaataaaacacccagtttccatggcaatagcatcctatctcaaagaaaaaggtgtttctgctcaaaatgtttctaatacaaaagctgtgactggtaagcgggtagaaggaacatcatactctggtttgaagttacaaggagggaactgtcgttggcttggtcataacaatgatcctgacgttcgaaaagcccttgaacaaggatattctgtattctgttttagtgttaatggttcagtcactgcagtttatgcattagaggactctttacgggcagatgctgtctccactattaacttgttacgccaaagagggatttcactacacattttatcaggggatgacgatggagccgttcgttctatggcagcccgtcttggaattgaaagctccaatattcgttctcacgcaacgcctgcagaaaagagtgaatatattaaggatattgtcgaaggaagaaattgcgatagttcttcgcagtcaaaaagaccggttgttgttttttgcggtgacggaacaaacgacgcaattggtttgactcaagcaacgattggagttcatatcaatgagggaagtgaggttgccaagctagctgctgatgtagttatgttaaagccaaagctcaacaatattttgactatgataactgtaagtcaaaaggccatgtttagggtcaaattgaatttcttatggagttttacttacaacttatttgctatccttttggcggctggtgcctttgttgactttcatattccaccagagtatgcgggtttaggggaactagttagtatcctccctgtaatttttgtagctatacttctgcgttatgcaaagatttagtccaggtactgctgctatttgattgtagattttcttttttcttttcttttttttttttgacgactctgtaatactctatttattatttagtttagttttctatttaatatgatggaattcataaaaaaaaaaaatacacatagccatgccaggtaattgcagatcaactgataaattagaaaaaaattaatgcatctttaaggttttaaattaaaaatgttttaactttaaagtcactgagcaataaaagttctacctaatgttgtaaaactgtattcataaccgaaacacattatgattatgtcatttggtattccacaccaaagcgaggagcattcaaaatgataccatttatgataccggcaatcaaaccagcaattggtaaagttaaaaaccaaccagaataacaccaggctaccattctccaattaactgatttgagatccttgttacataaaccaacagcgacaataccaccaacggcgatctgggttgttgaggtaggaatacctaattgggtagccatgacagtagtaatagcaacagctagttcaattgaaaagcctcttgatggcgactgcaaaatcatcttattacctagatttttgataatattgtaaccataagtccagcaaccaataactaaggcaacaccaccataagccagaacccacacgggaacttcggactttgccccaatagtgttagttttccagatcacatacacagcagacaaaggaccagtagcgttggcaacgtcattagctccatgagcaaaagacatagtggctgcagtaatggcttggagaaccgaatagatatattctactctattgtcgtaaaatttagatctttcgtacattcctttcaggtcaccagataacatatctctatcattaacttgagcatgaatgacgtcttgagtccaaccatgagagattactaaccagaacaataagggccattttttaggtccttgctttaataatgaccaccaatattgtttcgttgacaactttgtttctggttcagtttcagttctaaccaggtccacttcctggatgtcttctttgtttttgacggaatcattagaattactcgctgccttattttcttcgtcttcaacagaaacagttgttccaagatttcttctgccctcgtaataatcgattgttaattgatggccttctggcattggtgggatatcatcagtggacttaaagtaaaaagatggacctctgaaaatatcaatcaactttagtgtccaatcttggtccaaaacttttcttctgtagaatgggtagaaaaagatgaagtaaacgatcgaagcaattgcacctgtgagaacaatagatacggcagtttcagtttcagataaatcgtccaagtgtaggtttggagaacccttccagacaatcaacattgttaagatagagaaagtggcgaatactaaaacaccaaccagcagtaaagcattcttaatcgatctttccaaagacttaacttcaaggacagaaaacctagaaattgaaaaaactatagctgcgatcgcgcctgccaaaatcggagcaatgaaccatgacgcaataatttgagaaacaccactccaaccccaaacgacaccgttagctccaccggctgcaatcccagcgccaattgtaccaccaacaatggaatgtgtagtagaaactggcattccgattgcagtagcaaatgttaaccaacaagacgagccaatcaaagcactggtcatagtaagcattaaaacagcggggtcgttggtaaaaatggaggaatctataatgttgttcttgatagtaccagaaactcttgcgcctgccaagacagcacccaagaactcacagagacccgccaaaaccatggcttgccagtattttagagatctagaagagatcgacgacgcgaatgagttcgccacgtcgtttgccccgatgttaaaggcatccaaaaatgcaaataacatggcaatggcaaaaatatagtcaaattgatgtaaagccatttttgcttaatctttgtttatattgattcgattagatacgctccagtattctcacctttgatctatgtcactcattctatgacaattcatgtaaaataacctcaatgtaaagatcatcttcagcaggtttatatataattttcttcatatcgaaaaccgggcttagtgacatgaattgtttggagatgtccacccagtagacattgtaaaaaaaatctgctattgactgagttaatctaatgatttacataatagaaggatccaaagtggctgtgacatctagtattgatagattagtattattactatttgtctcccacgtgctgcattgtcatatgcaatttattaagattacataaactcctttgtacggtatattcttaaagcctttcaatgactcgggccaatttttagcaatatttcgacatttaagggcccactaacaaattaatggcacaacgtggggatgacgaaaaagcagaaaaagaaaaaaaaggtctatcgcacagccacacacccttgtggtgaagccgttttgtgatcggtgtggcgcgatctgtgaaatttaaacttttttgcgggtgaaaccgagatttctgaaactagattttctggcttcgccaaagaaagatgcatcgaattaatgaaattaaacggatgtaaggaatgaaattataacgattccgctaatgttctttactgacgagtgtcactgaagtacttactcgtgaacaaaaattaacctatatcagtaattttgatattgttaaaagtaggtatctctatcaaaagagattataagacccatcggcaaaactcgaaatatcgtcttgagaaaatcattatacagtacatggtgcaattttaaatgatttttaaatactattatataatcgatacatttagtacacgcgaagacaacgtagtgttgagattcaaagaggttacagttgaatacgtgacaaagctgacgagagtactgtgaattcaacaaaccataaatggtcactccaagtaacggtattgtgatttcaacagaaaacacaagcattgtgttagcgtgctcgtaaaatattatttcagcggtgaagcagatatgcgttaaaggtgggctcgctattaaatcatgaacgaaaaaacagttatgtcgttactggtgtgagtcgatattacgaaaccactggcaggtagatggatagaatgggactgattggaacagcgcaagtttttttccgtggtcggaattctcgtagtaatattggaaaatagttggaagaaaaattgtgtgaaaaaatacatgctgaaatagtcaaacgaagagaggtgaagaatagataaagctgttgagaggcaagacaatgttttcaagatgatcagaaaaggatacggtccaatatctatttatattcattgccctaccgtggtatgttaaaaaaatatgttacatttattgctcccattggattttgcacaggtgtgaaagagctcagttgtcaagatttagtcattaagaagggccgcagcagctttttgtataatagagcgtcttttttgtttgtgaaaaaaattttatggtgagatattgttcgattctacgaagtcattttactagtttatggactctgatataagacagagttgacaaggaaatggtgccgtgattgtttccgtgtacagcttttgagaacttccttgaaaaccaatcatctagcactttcatttctggggaaaaacctggaaccaaatcttgaaaaataaattccccagaagttttccttattccgtgttctaatcttctcgttcactttgcagtgacattccacggccatgcgcaatttaccccgcccccggattttattgtccgtaccgccatttttcaatagattaaaaaggaacaaaaaatcatttcagaaggtttctttctcgggaaaacactagagtgtaaatattgaatatcaaacatcgaacgagagcatcttgaagatatttatgttctaaatatgactttagtcaagtatgcatgcgactattgtcgtgtccgtcgagtaaagtgtgatggtaaaaaaccatgtagtcgctgtattgagcacaatttcgattgcacatatcagcaaccattaaaaaaaagaggctcaaagcctattggaactagaagcttaaagtatataccaaaggccaaaatgtttatagataataaaagttgtacggcagcggcagaaatattaatgaaggttcctaaaaaggtgattgatcagtgtttgaggctttatcacgacaatctatatgttatctggcctttactctcttatgatgaccttcacaagcttttggacgaagaatacaatgaccattacgtttattggtttctcgtagctctttcagcagccaatcttagcgatctacaaagcgaattagaatctgaggggggattttcgtttactggaaaacaattagccgttctctgtatgtcctcacgccaacaatttgatgaccttagcggcagagacattttccgaattatgacatattattgcttgctacgttgtttttcacagtcttctgatgtaagaaattcatacagactttgtcgtgaagctattggccttgttattgtagcagggttacatcgtgaaaaagcatacgaatcactatcatttcgtgagcaacagcttttacgcaaggtgtattatttgcttctcttgacggaaagatactattccgtatatgttcattgtgttacaagtttggataccacaatagctccacctcagccagagttcgtaacggaccctcgactttctttggatagcttttttgagatgattagagtatttactgtaccaggtaaatgcttttttgatgctttggctacggagtctactagcggttcttgcactgaagactcactgaaaaaaatatggaaagagcttcacacagcatcccttgaaatagaaccatggtcttatggctatgtggacatttcattttctcgacattggattagggcgctggcttggaagctagtgtttcagatgaatggtaccaagtttttctcaaacgccaataatgctcacatattggtcgaaattgcaaaggatatgctggacgacatattcttaactccaaacaacctgtatgatgtacatggtcctggaataccaatgaaatcattggaagtagccaatgcattggtagatatcgtaaataagtatgatcacaatatgaagttggaggcttggaatattttgtgcgatgtatccaagttcgttttctccctgaaacattgcaatcataaaatgtttcaaaggttttcaactaaatgtcagagtgctctaatcgatttgcctatctctagaccactgcgcctaaatgatgattccaaagatgaagacgacataattccttaatttattgttcacgccgttcacttatacgagatagatatactgatagagtgtgagtgatattcttaagtcttgcttttcgagggtgtaagaagctatgttcttcaggcgagattattctactcctgccttacttgtttgtaatatttagttctgatggtcatgataattctatatacagttacattaagtatatacttaagcgggcagcttactaatataaattttgtggcatttttgttgggatatgagaatcatgtatcgttgatttacaaagcgaatttacgttaccaggaatagggaatactctcttgaattctaacataagcacagaaatgctgaaagaatacgtcaaaaagtaaatttacagaattaaaaaaaaaataattgttgccggaacatgaatagagtgtatcaatatacaatataaaaattcaagcattttcattaacgggaatgaaaaaattgtatattagtacttctttttgcaagatatttaaatctaggaccctcatcacaatgattcatttaaatcattaacgttttttcagaacaaaataataacctctagttgaaaaaacttcaaagccgcaacaaaaccaaaaaaaagtcataatgtcgagtaaaaataaactcgatgtgttaagtactagttatataaaataaaattaaataacgccgtatctacctactggctaaaaaaatcatttgttcacaacagatgaggtgtttcgcccttcatctaccacagaagtttccaaatcttccttcggatctttaacattaatttctgcagctgctgctttggcagctgcaaaagggtcgactttagtcgacttgaactttcttgctggaacaccaagtctaaacaattcatttatctcaataaaagtcctgccagcggtttctggtaaatcgacaacagcccaagctaaagtggccagacaaaatcctccccagaaaaagcctgatttagcaccccaattccatttctctgagttcaattggtacatgatcaaaactgtaactacaacttggatcacattgtaagcattacgagccaaaataattgttttggttcttagccttgaagacggtatttcagacactaagcaaaaaacaacaggtgcaataccgaggttgtaaaagaacgcgacaaccattagaagagcaccactacccattttagcgccatgagtgtctgaacatcctaaaccaccgataatgaagaacataatagcctgaaaagccagcccaaaagcataaaggtcaaatctgccacaatattttgaagcccaccaggatataaacgttgcagcaataccaagacaatattggataatactgaaagtaaaagccgtatcagtgctaacaccagctttttcataaaagtaagttgaataaccaattaatgatgcaccacaggagcattgaccgatccaacataaacaagctattctcgttcttctcctgttaataccatctttcacacaatcccagtaagttccttcatcagacattttctgctccttttctatagtagttttgattttatcgagttccatactcactagtaattctttctcgggtcctttaccacttaatgttctttcaagtgatctcctcgcttgatcaatccttccttttttaaccagccaccatggagactctggtgcaaaaaaaatacctaccgccaaaggaaggggccagatccactgcaaagcaaaaggtagcttatatcctagttctgagttggcatatttgttctgggaatttttcataataccagcagcgaaaagttgaccgaacgcccaacataaattagaataagtcgtcaaatagtatcttagggccaaaggacaaatttcagaagcataagaaacggtcaaacattggaaacaaccccatggcataccacacaatgcctgtcccacggcaatcatacccaaactcttgcaaaaatacagaatgaaaatgaaagccgctaaaaagaacaacgccatgatcagagtgtaacggttgcccatgtaatctacagaaggcccagtcatttgcaaaccgacaatctcacctgccatgtagcatagacatagaccgatttgccaggaaactgaaatttcataatctcctgtattgctattcaaagaaccatattttttttgaaaaacaggcagggcatagaaagctcctagaatggctgtgtcataaccctcttgaatcaatgttgtggaaactaatagtgaccaagcagcagcttttggatatgtcttcaaagctgtcatgagtggcattcccctctcactttcatctgcctctttggcgtcctgcatagcttcatcgagaaggtcggggacttcttcattattatcgtttggtattagtgaacctggaccgtactcaagatgggaaagatcaaaatcacttttcttaccttgctcctccatctctatcgagttgaattcggtagcgttcacgccattctcgatctcatctaagtgtgagtcgttcctgtctttttttctgtttattaatgaggataatcccttcatagttaattaatagtcttggatgtaattcttattgttatactgaatacgctaaaaccactcacaacaagtatggagtatattgtgtctctttatatactgagtacttatgcaatatgcgctcactcaggatgaaatgtacacagccgaaagtatattgaaagctgcctctgtggaaacttctatctaatgttgtctccagatgtagactatgaggcctgaagaagtctttaaacacctgttggagagtataaggagactgctacaacaacgtcttccccacaaaaattatgtggaggccggtatgatacctgcacaaacgttaagttacacatgaaaaagagactgacataactttgatctctgaaaatatgttttcccctgagtagcttcactgcttggataccaatacgaatagaccttggctatagtaagttgcatctgtaccgtagagattcttgcaacctcgcttaaactctcgcttttatataatatttctccttattgcgcgcttcgttgaaaatttcgctaaacacggggtttaagtttaagtttacaggatttatccggaagttttcgcggaccccacacaattaagaattggctcgaagagtgataacgcatacttttcttttcttttttcagttcctagcgtacctaacgtaggtaacatgatttggatcgtgggatgatacaaacaacgtaagatgagtagttccttcctcaattcttctttcagcatcattttcttgaggcgctctgggcaaggtataaaaagttccattaatacgtctctaaaaaattaaaccatctatctcttaagcagtttttttgataatctcaaatgtacatcagtcaagcgtaactaaaatacataaatgactatttctgatcatccagaaacagaaccaaagtggtggaaagaggccacaatctatcaaatttacccagcaagttttaaagactccaataacgatggctggggtgatttaaaaggtatcacttccaagttgcagtatattaaagatcttggcgttgatgctatttgggtttgtccgttttatgactctcctcaacaagatatggggtatgatatatctaactacgaaaaggtctggcccacatacggtaccaacgaggactgttttgagctaattgacaagactcataagctgggtatgaaattcatcaccgatttggttatcaaccactgttctacagaacacgaatggttcaaagagagcagatcctcgaagaccaatccgaagcgtgactggttcttctggagacctcctaaaggttatgacgccgaaggcaagccaattcctccaaacaattggaaatctttctttggtggttcagcttggacttttgatgaaactacaaatgaattttacctccgtttgtttgcgagtcgtcaagttgacttgaattgggagaatgaagactgcagaagggcaatctttgaaagtgctgttggattttggctggaccatggtgtagatggttttagaatcgataccgctggtttgtattcgaaacgtcctggtttaccagattccccaatttttgacaaaacctcgaaattacaacatccaaattgggggtctcacaatggtcctaggattcatgaatatcatcaagaactacacagatttatgaaaaacagggtgaaagatggtagagaaataatgacagtcggtgaagttgcccatggaagtgataatgctttatacaccagtgcagctagatacgaagtcagcgaagttttctccttcacgcacgttgaacttggtacctcgccatttttccgttataacatagtgcccttcaccttgaaacaatggaaagaagccattgcatcgaactttttgttcattaacggtactgatagttgggctaccacctacatcgagaatcacgatcaagcccggtcaattacgagatttgctgacgattcgccaaagtaccgtaaaatatctggtaagctgttaacattgctagaatgttcattgacaggtacgttgtatgtctatcaaggtcaggagataggccagatcaatttcaaggaatggcctattgaaaagtatgaggacgttgatgtgaaaaacaactacgagattatcaaaaaaagttttggtaaaaactcgaaggaaatgaaggatttttttaaaggaatcgccctactttctagagatcattcgagaactcccatgccatggacgaaagataagcccaatgctggatttactggcccagatgttaaaccttggtttttcttgaatgaatcttttgagcaaggaatcaatgttgagcaggaatccagagatgatgactcagttctcaatttttggaaaagggccttgcaagccagaaagaaatataaggaacttatgatttatggttacgatttccaattcattgatttagacagtgaccagatctttagcttcactaaagagtacgaagacaagacgctgtttgctgctttgaatttcagtggcgaagaaattgaattcagcctcccaagagaaggtgcttctttatcttttattcttggaaattatgatgatactgacgtttcctccagagttttgaaaccatgggaaggtagaatctacctcgtcaaataaaattagtgccgacttttttttagcgcgtactttaacgaaataacagatgatttttcacatgatttttgttagataaattttttatatgtaaatgatgataacgtaaaagcactgttgataatttgtttcaccattatgggtaaatgtgtttttctacatgatcctcgttcattatgatatttagcgtgtatataaatgtgaattccaaattattaatgaagcataagaagcactatcctttctcttcggatgaaaacaagggagaagaaacctgtgctggtattaatgctggaatgtcttgctaagaatcatacaaggtggtagttttatttaataaagaaaagaaaaggactagatataaaaagtgaaatgaatataagatagcgttaagagatgcccacagtacttgacacataatttagcgttttctcgggaagctctgtgattttatgattcaataacacagcgtaattgatttcgtgatggttcgatcctatatgtaatctcatgtaacactcaggcgagttacaaaatcgattcaacattgccggcttatgcgtttacgtcaagtctgagcatgcctacccccttccgaacccgccttttattgtctagccttcagatgaactaaaccaatcatctgtccataatccatatgctttagacagtgtgattaagcaaaagaaaataagcgcataagaatcttgctacttcggtaactctacaacattaacaccccacaatcaatatataaaagccaacgaagtgaagagaagaggtggaatgacgctcttatcctttgagaaatttgactacgaaaatctgtgtcccctatgccattagttattgagctataactatatatcagagaagtgtagttattcttcagcaacgggcctataatctggatacgtatgattacttatcgctgtaataattgtaaattcctggaagaaaaacacatgaccagaatgatagacatattgaaacggtgaataaaagggagaaaaaggcttaaaggctttctgtattagtaacactaagccctctatcaatttcatccaaacagaaagactgcaggtacatccataggatagaagttctgtatgtaagccgccactttttgtctccttcacttaccatataatgaatagagaaacgtagacctaggcggcaaccgttgcctaacatacgaagcgctggtgctgttctccgattattagtattacaaaaaaaattatataatacttattaagatgttgatttatcaatttccggtatagtttccggtatggccagcttgatccagtggaagttccgctgtttcagaactagggcttcgtagcacctcgaatgctcatttattcttgtcaacatttttgctggcagtgtataagactgtaggcacctacaatatacgactccggtattcgataagtctttcactttctattttaagaaaaacagaatcgacaattttcccgtagcaaccgtttagagcacaaagattaggtggcctcttaacgagggttcaaagcaaatttggttttggctttttcttggccaaaagctgcagctgcatctctgaaggcaccctaaagggattcttcggaagtatgtacactgtgagaaaacattcttgtgccttggaaatgcaataaaaggtataggcactatgaagcgtgcgcctcgtatacgggacctatgaaagacgcatcgttcaagtacagaagcaccgtaataatatgaataatgaatgtgggatgaaaattgtacactgaggcattttaggtgagagatgggtgccagatgataactcgtttgtgccagggaagttggcaagacattcatataaatagagctgctgtagctatccatctttgaggtatgcgctttcatttcactatttcttgttaagcttacatcagcactaaaaaacaaaacaaatacaatggtcaaactaacttcaatcgctgctggtgttgccgccatcgctgctactgcttccgcaaccaccactctagctcaatctgacgaaagagtcaacttggttgaattgggtgtctacgtctctgatatcagagctcacttggcccaatactactctttccaagtcgctcatccaactgaaacctacccagttgaaatcgctgaagccgttttcaactacggtgacttcaccaccatgttgaccggtattgccccagaccaagtgaccagaatgatcaccggtgtcccatggtactccagcagattaaagccagccatctctagtgctctatccaaggacggtatctacactatcgcaaactagagactgatgcctttacgaatgaaattccataaaccttaagaaataacggaaaaaaaaaaaaaagctttttttttttttgatagtataaatagttgattatatgtaagtgtatattaatattgttactactggtcaatcgtgatatttatgaacaacttggcggagcaaggacaagaatcctctcttccttttgtggtattcttcgatgtgtgtccacttcaacgacatgggtcatcaatatctatgttaaaaaatcatattttagactcacttgctagtaaaccggttgatgctattgttaatatataacgacaaatgttcaagcaattatataaccattttcttccatattcaccttaaacgaggtcgcctttatttttttttttttttttttcagggcatcgatcggcccggagtcgtcgccttcaaatgtgtcaaatttttaagattaaagttatcgatcttgaagtttttcgtggcaggagggtttctatttagtgttcaataaaggctttcatgagcttttgtatattccttgattaacaataaatgtggaaaacaagaagggtaattgtgaaagagtccgattgtagttgatgaacagtaaaatcacttattatttaaggattccgctgcggtatgcgttttctactgatgtgtggagcaagccacgccatgtgattaaccttgcttgataaaaacacaaaccatcgttcagaatatgcatggaatatagcatcactgggaggagaaagacaataagttttgcgcatatggtaggatggtggcacatcgagttctctcaaccagtgagaaatagggaaaaagaaaatggttgtaatggtaaaaagtagtctcgttttggtaattcgcagctgacaaactacaaaatatataaattgaaaaagttgtatttatctctacactaagagcacctcactgcgggataattgcgcttctttaatgtatggccatagttccacattcaatggtaaaggccacatagatttcttcgcagatagaacgcggtagaagaagtggttaaaaaaccattcacagtcaatcccgtcgaagaaaaactcttcattcttccaggcttttttctcaaacaagtacctattcattttccttgcaatttcgtcccatccattcgcaccactttcttgctcatttataatagtcgacaagaactgcatcttgtgttccatgctcataatcaaaacccttatattttggaaaccttgtaccaacatgaaaagaatccacccgagatacaaggtgcgtaatagaaggcacattccccgtgacacatatatgcagcacaaaaaattaaggaatggtatcaacataaaaatattggaaatcctctttaaaaaccaagtaagcttaaatcggtaagcttccttgggaagtttagcatcttccaggccaacagggctccatgatttttcagtattaaacaatttccattgtttttcaacttctgtaaaataaactcccaatgcttcttcaatgtaagggacggaatccttaaatgacttaaccttggcagctttatcttttttcaaagaaaatggttcgagaagggttgttctgaacgcttcttgacagaccatggcattgaaaaaaaagtacttagtattccaaacgttattttcatataagtacgaatttagatttgctgcaacaacttcccaatcatgaggatcagaacttggtgtgttttcagtaatctctttgcaaaactgaatgagttgtttcgataaggaacgcttacgagaaagtccacaaataacaaggacaaatattggtcccagaaacaggaccagaagtgaaactataagtgggtaaatacaattgttggaaagtttccaccagacgctaagtggtagccataatagcatccagatgcgaaacgctaaggacttgtaaatttcataacaaaaccaggtaaagctgcttctgaaaagatcttgaggtagaacaatcttttgggattcgagctgtttgaaggataatacatctacactcttctcatttttaagttcattctctttcattttcggtagtgagatggcagttcgaggggttttttattcgagatagtaacttctggcttttcgcttttatacagcacagcagaaaaaaaaagccgccgaggcgcgcgcgttcatgcaatggctcagtaacctcgtgatagaaaaagggcaacaatattgggctattttaggcaaagaaactcagctattcgaaaagggcatccattacatttccggttttctatctagccaactcgataatcgtaataacgaatttacaaaactttaatgcgggtacatcacggtgtgccgtaacgttggttcacatttagggtgcgaccagcaatgtcactgctcgtacagcggttaccgcttgaatgaaatacatattttaagcgtagatttcctgtgacaaaactgtgtaaacatctagtagaaaatagacgtagctgtcacaaatatttacacaggaaagagtctgtcctacgtatctgacatgaagattcatagaaccaagttacttcccaatgtggacaacctttcgataccatgtcaatagcttccccttatgttcggtgtcactgtaaaacggatcaaagcaaaacctagaggtacggtggtactcagatcatgcatgacctctgggtaattagcacttctcccgcttgttttgagattctgtatataaatattgcaaacaaaaggatagagcgcggatggcagcccttacagtaaaaattattcgttttaatcatgcgtcagtgtgagattctatgacaatagtataagatggggtgaagtaaaagcgtctgtatgactatagagtacagttatattacaatatatggaatagagcatagtggtatgacgatattaaggaactttaagttaatgataccatgatagtattaagacgcaattaagtgtgtttatgtattatggttgaaggatagaatatttttatgtttaggtgattttagtggtgatttttttgtaatattggcataagtgtatataaattgagtggttagtatacggtgtaaaagtggtataacgtatgtattaagagctgttatacaatacttggggccgccgaatgagatatagatattaaaatgtggataatcgtgggagttatgcgtaaatggcacagggtatagaccgctgaggcaagtgccgtgaataatgatgtgagtgcatttggtactgatttagtgagaatggggccatggtgtggaatatgaaagtagggtaagtttgagatggtatatactgtagcatccgtgtgcgtatgacatatcagtagaagtgaaggtgagtgtggcaagtggcggtggtggtagtggtggtatagagtggtagggtaagtatgtatgtattatttacgatcatttgttaacgtttcaatatggagggtagaacaacagtacagtgagtaggacatggtggatggtagggtaatagtagggtaagtggtagtggagttggatatgggtaattggagggtaacggttatggtggacggtggttagtggtaagtagagagatgatggatggtggttgggagtggtatggttgaatgagacagggtaacgagtggggaggtagggtaatggagggtaggtttggagacaggttcatcagggttagaatagggtactgttaggattgtgttagggtgtgtgggtgtgggtgtggtgtgtgtgggtgtggtgtgtgggtgtgt

SEQ ID NO: 12206 - DNA, 315341 bp, Saccharomyces cerevisiae
cccacacaccacacccacaccacacccacacaccacacacaccacacccacacacccacaccacaccacacccacaccacacccacacacccacacccacacaccacacccacacacaccacacccacacacacccacacccacacaccacacccacacacacaccacacccacacacaccacaccacacccacaccacacccacacccacacaccacacccacacccacaccccacacccacacaccacacccacacacaccacacccacacacacccacaccacacccacacaccacacccacacacccacacccacacacaccacacccacaccacacccacacccacacacccacaccctaacactaccctaacactaccctattctaaccctgattttacctgtctcccaacttactctccattaccctacctctccactcgttaccctgtctgattcaaccgtaccactcccaaccaccatccatctctctacttactaccaccaacccaccgtccaccataaccgttaccctccaactacccgtatccaactccactaccgcttaccctaccatcgaccatgtcctactcactgtactgttgttcacccaccatattgaaacgtctacaaatgatcgtaaataatacacatatacttatcctaccactctaatcccactaccacatgccatactcaccttcacttgtattctgatcggtcatacgcacacggatgctacagtatataccatctcaaacttacctactttcatattcatcatcacccatctctcaccatcagtaccaatgcactcgcatcattatgcacggcttgcctcagcggtctataccctgtgccatttacgcataacgcccatcattatccacattttaatatctatatctcattcggcgacaccaaatattgtataactgcccttaatacatacgttataccacttttacaccatatactaaccactcaatttatacacacttatgtcaatataaccacaaaatcaccactaaaatcacctaaacataaaaatattctactcttcaacaataatacataaacacactcaattgcgtatctataccaccatgacgtcattaacgtaaaagttccttaatattgcaaattgcttgaacggatgccatttcatgttgaatgtggtaacccaatagcatgatatgagtaatgctttagtattgtttcagagttgtttcagtaatgttttagacaaggagaacatatagtagcaaacctctaatccggtagtacttaagaaactacagtttctatgtacgaaagcagtaactatgtaattattacatttacatgacatataggaaggtccaataaacttactacattatgacctataagctagatcgtaattcattacgtcaacaggttatgagccctagagcaatgcttctgagaacataatcaatctatctagccccaacaattataaacagtggctgtacggtatcgagaccgctgctgaatatgctaacgaatatatgaacgaattcgttcataccggagatatccaatcaatgaaaagggattacaatctcagcgcgaatgatgaaagctttgtcaaaaccgtatttaacagtttcctggtaaagctctacaagaaaactatcgtgggtgaagctgcatgtgaaatgaactggatatgtgatgattcgcttggaagggtctctgcttatgatattttctcgcacttcgaagaaaactataatgaagtcactattggatccaggcttactcttatagaggacctaccaaatatatcctccaagcctgtagatgaaattgcttcctttttgaaaactctattcacgatgcttgaagacaatagcgaagaacaggacaaaaaaaaaagacgcgacaccaatatcgcgttgttattaatgaccttcttacccgagttaaaagaatcattccacgagaaattcggtgactctaaggctcttcagctatcacaagtcattagattctgtaaattaaatgcgtcatcgaattcatcatcttcggtctcagatgcattggttgcacaagacagaagaaactatcaaaagaaaggaaataagggatgtatataatttacggagctgatcatcgcataagcaactgttctctgcttaaacgaagaataccagaagcacgaatctttaaattatatcctaatgacaaaacgagtagatcttcatctgctagtgtcgcgattcctgactatgaaacgcaaggccaaacagcaggacagataacaccgaagtcctggctctgtatgttatcttcgactgttccagctaccaaatcctcagaatggatttttgacacaggatgtacttcccacatgtgccacgaccgttccattttttcatcatttactagatcctctaggaaagactttgtcagaggagttggcggttccatacccatcatgggctccggaactgtaaacattggcactgttcaattacatgacgtatcttacgttcctgatttaccagttaacctgatatccgtttgaaaactatgcactaaatcaaactcttctgttacgttcacaaaagagggtgtcactgtgcaatcacctgatgatgtggtttctacagctgggtattcacaataaaagactctgggaagtacaaagctcgccttgtcgcccaaggacatactcaaaaggctggtattgactatcaggaaacctttgcaccagtcattcgatatgactctgttagattatttctggcccttgctagctgcctcaaactaatagtatatcagatggacgttgacactgcgtttctaaactcaaccatggatgagccgatctacgtaaaacaaccacccgggtttgttaacgagaggaatcccgactatgtatgggaactatacggcggtatgtatggactcaaacaagccccattactatggaacgaacatatcaacaatactcttaaaaagattggtttctgtcgacatgaaggcgaacatggcttatattttcgttccacatctgatggtcccatctacattggcgtatacgtagacgacttacttgttgctgctccctctcctaaaatatatgacagggttaagcaagaattaacgaaattatactcaatgaaggatctcggtaaagttgacaaattcctcggtcttaacattcatcaatcgacaaacggagacatcactctctcccttcaagactatattgctaaagctgcatctgaaagcgaaataaacacatttaaacttacacagactccgctctgcaactcaaagcctcttttcgaaacaacttccccgcatctaaaagacatcactccttatcagagcatagttggtcagcttctcttttgtgcaaatactggtcgtccggacatatcgtatccagtctcattactctccaggttccttcgagaacctcgcgcaatccatttggagtctgctcggcgggttctacggtacctatataccaccagaagtatgtgtctcaagtatcgctctggatctcaggtggcattaactgtatattgtgatgcatctcatggagctattcacgatctcccacactctactggggggtacgtgactctacttgctggtgctcccgttacgtggtcatcgaagaagctcaagggtgtgattcctgtaccatctactgaggcagaatacattactgcaagtgaaactgtcatggagatataatggattcaaaacttgtttgaacacttaggccagccacttatctcatcaacatcatatgtagataataaacctgctataaaactgtctaaacatcctgtatttcacacgagagcaacacacattgctttgagataccacaagctaagaaatgcagtggcagcaggcataattaccatagaacatgttatcacaaagaaacaagttgctgacatatttacaaaaatccttccagctgaatcatttaaaacacatagggctgtcatgataagggaaccagaaactacaaaataaccatactcatgcgtattcagttatggggggatgttaaatgtggtaacctaatagcatgatatgagtaatgctttagtattgtttcagagttgtttcagtaatgttttagacaaagaaaacatataatagtaaacctgtaatcaggtagtacttaagaaactatactttctgtgtacaaaacactaactatgtaattcttacatttacataacatgtagaaaggtccaataaacttactatattatgacatataagttagatcgtaattcactacgtcaacatatcccacgataaaaaaaataccttgactcaagtgccgaaacaggaaataatgaaagatttcatacaaggttgtttctaaggtgctatatgtccctacggcctcgtttagccccatctcgcatgcaataccgtaacataggtatatacacacagagaagtagtaattttacgtgtcttatacttattttatatagaaatgtccgacacttgcgctacactaaggcatataagatagatcttaattccttgtattaacatataaacagacaacataacatagccagtttatcttacttatcttttcctggaagagatggcattatttgtgtgtatcaaagaggcctttttcaattttcattttaatatttttttaatattcttatattgaacacatttttctcccctagatttatgtttcctattgctctccatatcacattatatctatgaatgaatatgcattgctcttctgatactatggtatgagaggccttggtaaagggcatcgataaccgaaagaatcatccgcagagaagtagaatcttagagcatatcgtctcgttgagaccgtatagattcgcaaaaataacagaaacttgcgttaacattgaatttcaaactcagttttccataattaactgttaaaaaaggctactataagggtgtcaattactgttctgtttcgcaggattaattccgttatgtgctcttgtaattgagttagcgcttcttatatctcttcagtaatgcagcagtaataaaacacattggcttcgctttcgctttttttccaaatcattatcgaagattctttgcttatgatatactggtgctcgaggatgatgagaggacacaactttttgaggcttatcgttatcgtctgagtcacaacaacatacattaactgtccacgattcagggatgtgctatgagttcaattttcgctgtagtgctgccattggcgctgctactggtgtctggaaaaactccacagctttcaatggagatgtgactgcacgagtgagacattatctgtattagcttcacaaccatactctgttagtaaggagccatagtcaacaatcctaggagttccagctcaatcgggtatgatatcatctctgatacccccaaaatacatggctgtaccatttaaaataagtggtatattgaagaacagtatatttcagcctatacaggatcctactctttcaacaaaaatgatttcatcaaaattaaatcacgctgcaacattggtgaagaatctcaaaaggttagtaacatcaatatatcgcggaggtagctatcattgtggtagctaatttaaaggatatacagttaattcaacaagattttcaagtccatttcttttgggcacgctgaacacgctcaatgtagtacttgttttggaaatcactcgcaagtttaatgggacgaattatatcagtaatgtgtaaattccgacacaatgttcggttagtagatttactgctggattattgggttcacccgtagaccgttgccgactccaagaaaactatgatctcaatacaggcataaagaattgttgtatctgtgcccatgtgatctgtatcttttttgcggtaccaaaatcgcatgttgcactcacactacggaacacatcaacttgtaacgacaacaatgcaaaataccgggagacatatcacttcttttcgcttagaatgatttacaatggcatacacttagaaaagtgctatcacatgacgcccttactagaagttacatgattctcttttttttcctttctttctttctttttcggtacaacataattaatgcattcatacagagcgcatttccagcatcttttattggatagtaactcctcccgcacttttaatatcaatgacgctgactcttttactgacactgattctttaccgacgctgagtctttagtgacgttgagtttttaccgacgcctttgaaaataaaaagtacgacacagctatatgcgtagcaagttcaaatgtgggtctatcgagcatgtttatcctatcctgttatgtcatttttatcgaaagtaataaaaatatagaaaccacttgtttttgccttttttgtgattttgctttcttttttttttttttcccttttttcaccagcttgaggatcaacatcctgattccttgtcacttcgattatgtttaaaaagtgccttgatttgagagaaaatgttttcctcatctggcaagacaaccaaaccatcttcagtgaattcttcgtgtgtcgccttgtctattagttccggatctctcatgaacattgtaaacgcaaagaacggtaccgtacatgccaagccaaccgtcattattattcgttgaacatatctgtaagattcaaccacagcatctctttcggatgagccccaaggataatcattaatgaatgtataaggtgatgcatatgctatttctgccaatgtatcgtttccaaggttcttgtagagttggttaggcatggtttgtgtccatatggcaccagaaacggaggcaccgatagcagcgcctagcttcgaaaaggtatattggatgccggttattacagccatcctactatgcgtaatcatggcttgcagtatgacgatcactgaattgctgcataggagaccgctcaaacccatgataacagatgcagcgataacaccttcatgagacccggatcctcctctgtatttgtaaaaaaggcccatgcacaccatccatgcagcacaacctccgattacagaaagtttcagtttcctcgtctttgccaccaacaaactgtagaatggagatgcagtagcagcaacaaagtcaggaaggtttactatccgagcagccgaagtggacgattctttcatcgataccagcaaaacaggatacagatagtcacacgaaatgaaaaaggtgaaaaaattgaaaaaagtaacaccaaggggtgcccaaattccacgatcacttagtaatttgaacggtagaagaggagatttggcaaatttggcctcccaatataaaaaaatgaaaaataaacagccacctgaaactaaagtggcaattatttttgaattgtgccacttttgtgatgtctcattagccaacgtcaaaggaacaagaatacaccctagcgacacagttattaataatatgccaacaatatcgagtttccagaatagaaacaccaaattctcaaataatccgcccgttctttcctttctagcctgttctttgagagatctccactcagcagtctttgaagatttgtacttcatataaagaataagaaatataattggcaaggcagagagtgggtaaataaaagcccacattgcaatattccaggaccagtttttctgaggatttgctgctgtgataatattacctgaaatccatggtattatgatatatggccaatatgaggcgtactggtaaaacattctccatttcaaggaggagaaatcagaaagtattaatgtcaggagcagatttgttccgacgtatccacagttatagaaaaccgatcctgctgcatacattgtgagacgggtcgcctgtgattgaatgatggttcccattatataaaaaatagttgcaactaaaaaaagcctcagtcttccgaagtggtcagagagtctggagtagacaacttgggatccgacactcacaacagcattgataacttggacagttgaaagtaaggagtgttctgaatatgagttcgtcgcatagcccgtataggtcgatctaagtgtgtagtctaaactaattccaaacccacatacaaacgcggtacttatcagtagaattttatatttcaaggaatcaaactgtgcagacataatttcgttttctttgagcttaaaaaaggtcgatgtcatagagtacgtgtcatcgtttgagtgacgttctcgctcaataatctcacaggactgcctaattccactttttttattacttgaggcaccaacaacactagaactcatccgataatttatttacttgattattctttttttttttttttttctctttccagtccataaaactattttacttttcttatttatgtaaatagtatttaagattctacggtcgctacatctgctagaaatggaattactttaatacattccatgttctcatatatacttttactgacacctttcgtcactattttttgtttaaccttttttttggaagcactaaaattatatgctcgtaattattgagcatcaaaaaaaataaaaaaaattgctgtgacaccccttcaatgtggtgtctatacacctggtgactttaactttaactttgacctgtcgtcgtacaatcaacttagtttctgaaaatccacaacgaaccagttataccgaagacttttgtacgacaagaatactgtactgtcgaaactatctcttttcaaactgatgagcgaagcttgtgtttatgtctgttgaaacaaggaaaaaaatgcggtgcctgtcgacaggatatgcgcacaagtgcaaaatcatcaaaaaattgagtacctagatccggtggtgtaggacgagcaaagttccttcataaacaaaccgtaagggttactgatacacaatttcctttttgtaaagagtatttgagcaaattagtcagcgattgaaaacaacacccttttttctatatatagtaggtgaaagttaacatgcgagtaaaagtagtgccacatttcctttgcagcaggtgcaaattggtacatatttaacagatagcgccgcacctcatatgcagcgcgtacatgatacgagacgacaagatatgcaaaagataatagtgtcatcacacctttatgagaagcgaatttttttttttttttggtttaaatatatatatatacatatatatagatatagatatacacatgtatagatgtattctagttatgcttatacctagaactgatcagaccagatcatacctggtatagagcttaatcgatagaaattcaaaaatatggaggaaactaagtactcttcgcagcaggagatagaagaagcatgtggttcagacgcttcattgaatgctagaggtagcaatgattctccaatgggactttccttgtacctctgcctggcttcgtgaactcttgtactattcataactgcactggatattttgatagtgggaactattattgacgtggtcgcagaacagttcggaaactactccaaaacaggttggctcgttacaggctacagtttaccaaatgctattctgagtctcatttggggaagattcgcatctatcataggtttccagcatagtctcattttagcaatacttatttttgaagccggatccctaattgctgcccttgcctcttcaatgaatatgctcattgtcggtagagttgttgctagtgttgggggaagcggacttcaaacgctttgctttgttattggttgtacgatggttggtgaaaggtcacgtccattggtgatttccatcctaagttgtgcatttgctgtagctgctatcgttggtcctataatcggaggtgcctttacaacccatgttacctggaggtggtgcttctatatcaatcttcctatcggtggtcttgccattattatgtttttactcacatataaggccgagaataagggtatacttcaacaaattaaagatgctataggaacaatctcgagctttacttttagtaagttcagacaccaagttaattttaaaagacttatgaatggcataatcttcaagtttgacttctttggttttgccctctgctctgcagggctggtccttttcctactggggctaacctttggtggtaataaatatagttggaactctggccaagtcatcgcatatttggttttgggtgtcttactttttattttttcattggtgtacgatttcttcttattcgataaattcaacccggaacctgataatatatcctacaggcctctccttctaagaagattggtagcaaaaccagccataataataataaacatggtaacatttctattatgtaccggttacaatgggcaaatgatatactctgtccagtttttccaacttatatttgcgtcgagtgcatggaaagccggtcttcacttgataccaatcgttattaccaacgttattgcggccattgcaagtggtgtgattaccaaaaagctcggtttagttaaaccactcttaatatttggaggcgttcttggggtaattggagcagggcttatgacacttatgacaaatacgtccacgaagtcaactcaaattggtgttttgctattaccggggttttcccttggatttgctctacaagcatcgctcatgagtgcacagcttcaaattaccaaagatcgtccagaagctgctatggactttattgaagtaacagctttcaatacattcatgaagtcattaggtacaactcttggtggtgtgctttcaaccactgttttttccgcctcctttcacaacaaagtatcacgagctcatctagagccttacgaaggaaaaacggttgatgacatgattttgtatcgtcttcaaaactacgacggttctcattcgactattggaaacattttaagcgactccattaagaacgtattttggatggatctagggttttatgccttaggatttttgttttgtagtttttcatccaataagaaattaatcataccaaaaaaggacgagacaccagaagataatttagaagacaagtagcgcagttattttcttattttcattttatttttttcgccttttatacagacttcaacacaatcagaatcaaataggtgtatcgcaatggaatgtaatttcttaagtattctatatgtacttaaaacctattaatatatggatcaacacagtatcttatgaatgggtttttgatttttttatgtttttttaaaacattaaagttttcggcacggacttatttggaattcaaattattaatgaaagaacaattaactaattaatgtacttagtatttggccattattatcgatttcgggggccaaatctaaccaaattcaacctacattttttcaaattgattcaaacacctttcacaataagatttttatatctagcgcacatagaatgaaatgtaaacaaagatttcagaaaaatcgtcattcaaacttgtattagacgagggacggagtgatttttgtgtttgtttttattaattgtgggataggatagtagcaactcttggaggagagcattgtcagttgtccagtctctgaagttaagtagtaagtttgcggagtcaaagggggatggcttttgccatttgtgagagttgtgcggcagcatcttattcaaatagagctgtattctgaagacctcttgtagaacatcatccatactaaaaagtaaatcgtcctgtcccattacgagctgtagtagtgctgtgaccctctgtatatttacgttgccatgaagaaggtaatgggcgatattttgatacaattcctgagttgcatgttggattgagtttacgaagggtcgccagacggccagaaacctccaggcggagttaacaactagtaatacggcatccatgtttgcatcagcgccgagcctataccagtcactgagtagacgttttcttgctctttttatgtcctgacttcttttgacgagggggcattctctagagacacaggcagttgcttccagcaactgcggtacggccgttctcatgctgtcgaggattttttttgggacgatattgtcattatagggcagtgtgtgacttatgaattgttgtagaaggacgtctgtgatgttggagatatgtattttgttaactcttcttgagacaatttggccctggatagcgaagcgtgcggttacaaataggtcgtcttgttcaagaaggtaggcgaggacattatctatcagttacaaacatcttagtagtgtctgaggagagggttgattgtttatgtatttttgcgaaatatatatatatatattctacacagatatatacatatttgtttttcgggctcattctttcttctttgccagaggctcaccgctcaagaggtccgctaattctggagcgattgttattgttttttcttttcttcttctattcgaaacccagtttttgatttgaatgcgagataaactggtattcttcattagattctctaggcccttggtatctagatatgggttctcgatgttctttgcaaaccaactttctagtattcggacattttcttttgtaaaccggtgtcctctgtaaggtttagtacttttgtttatcatatcttgagttaccacattaaataccaacccatccgccgatttatttttctgtgtaagttgataattacttctatcgttttctatgctgcgcatttctttgagtaatacagtaatggtagtagtgagttgagatgttgtttgcaacaacttcttctcctcatcactaatcttacggtttttgttggccctagataagaatcctaatatatcccttaattcaacttcttcttctgttgttacactctctggtaacttaggtaaattacagcaaatagaaaagagctttttatttatgtctagtatgctggatttaaactcatctgtgatttgtggatttaaaaggtctttaatgggtattttattcattttttcttgcttatcttcctttttttcttgcccacttctaagctgatttcaatctctcctttatatatatttttaagttccaacattttatgtttcaaaacattaatgatgtctgggttttgtttgggatgcaatttattgcttcccaatgtagaaaagtacatcatatgaaacaacttaaactcttaactacttcttttaaccttcactttttatgaaatgtatcaaccatatataataacttaatagacgacattcacaatatgtttacttcgaagcctgctttcaaaattaagaacaaagcatccaaatcatacagaaacacagcggtttcaaaaaagctgaaagaaaaacgtctagctgagcatgtgaggccaagctgcttcaatattattcgaccactcaagaaagatatccagattcctgttccttcctctcgatttttaaataaaatccaaattcacaggatagcgtctggaagtcaaaatactcagtttcgacagttcaataagacatctataaaatcttcaaagaaatatttaaactcatttatggcttttagagcatattactcacagtttggctccggtgtaaaacaaaatgtcttgtcttctctgctcgctgaagaatggcacgcggacaaaatgcagcacggaatatgggactacttcgcgcaacagtataattttataaaccctggttttggttttgtagagtggttgacgaataattatgctgaagtacgtggtgacggatattgggaagatgtgtttgtacatttggccttatagagtgtggtcgtgccggaggttgtttatctttcgagtactgaatgttgtcagtatagctatcctatttgaaactccccatcgtcttgctcttgttcccaatgtttgtttatacactcatatggctatacccttatctacttgcctcttttgtttatgtctatgtatttgtataaaatatgatattactcagactcaagcaaacaatcaaagaaatctttcactgctcttttctgtgttccatttagtttttagtacgattgcattgtctatatactgtatttaccaaatcttaattttagtcaaacattaatgtttactttcgtatttaaggatgtgtatactaagccttgggaaaatgcgtgttccttgtgccatccgaaagctacttcataaaaaagatactgttcattttcaagcccgcatagttggatcaaatattaactatatatcaacatggtccaaagatcgtaagtttggtctaatgttgttttagcaaaaaaaaatactatacctttcattaacgtttattgaatttcttgaaaaaaaaaccctaaattattataaaattatagcaggatagttcttagtggaagatattaagcaaactattttctgaattgctatgcgaaatttctctaatgccagctgagtaactaactctcatggtacataaaaatacgcatcttaaaaaatttgatatttcatgatttatttatagaaataacgatgcttattgtgctttgttgggtgtttgacttctatgttaacttacttcaacatgaaagcccgacgtttgcaatgatatcctctttttcacccgattattttcatttattagtaagtggggttctgggtgaaaaaatcaaaacaaaaatatgaatttgtaatgatttttatattttcgccggaggtgctggaaatggcaaacgaaaatactatgacataaaagctgggcacactatgtacgttctttttaattttttatcaacatgagaaaaattcatgaacactgtaccttatattatctaataaatgaagtaagctttgcatctccgtaacagctgcatatatataattaagcgggagctttctttcgatctctttcattccatatgtttattatgtactgatgaaaagcattttactaagttgaggtctctgtaagtatattgtgaccattatgctaaaatactggggtcttcatttgtgtcaaattctacgtaatagttcccctttttcttacatttttatactaaagagttacggtatttatacaaacgaggggctttactgtaatatatgattaagattcaagctgaaacattctaagttagaggtataaaatgattattgatgaaagagctgcaaatgtcggcaaaatataaataccttagatgttaccagctgggaagattattacggaacacattcttataaatctataggaatacataggattgtatttctattgacaaagtacaacctatattttatgttatgttatgttatgtttgctatgactatagttgcttttcttcacttagtaaggattaactaactctcgagctagtaaatttgacgtgagaagcataattatattactaatagaacgatatctggtgtgttttattacagactgcactgagtgttagaggtagaaattataagttaaaaagcagtagtttatgctttatgctcgagtatcaagtgaatttgaacaggctagtgcttcattggtacttctttcatggataattttgagcaaatttctgcagcatgtccccctttatacaaattctgtgcattgccggcctagaaatatgtcaacgttttggatatgttgatgcttacttcgagaaatcttacactaatacttctggaaaaaatcaatactagcaaaatagtgatatatgagtaaaatgtatgtagtacatgtatgaaaattatcaagggcaaattgatgcttcaacgaaaaagttattggattttcaagcactttttaaattcacaatatttttttctggaaatatgaaattgtcagcgacttctattacaggagtgtctttttttctcatgctatccaacgcttcttccaagtcctttatagtattagaggagctcgcacaagcaataattatcacaatgtcatccgcagctaattttgagcccagtgcattttctaggatcttagtgttgtaacccaaatgcaatgcggcgccacatgccggttcaatcaccatattgaattgatgtgtatatttaagacagggttcaataacatctttgtcctctattacaacggatctggtgttgtatttgcgagcgtattcgaaagtttgattagagatcacggccgttcctagagaagtagcaatacttgttatcttcttgaattgaactggttggcctattttcaaagaagtattgaaaacatgacatccattcgtttccacccccacaatagggatcctatcagctaaaccatacctttccaaaccttgaataataccattgtataaaccacctccaccaacgctgcatactatgcctttaaccttattcacggaaatatgttgcgatttcaaatcttgtactatttcatctatcatagatgaatgtccttcccaaatatccggattatcgaagggatgaacataaatgggctcaatgacctgagagtctattttattcatgacatttgtttttaaaaaagtatctgcttctttccagtaggcaccactcacgataacctgggcaccggtgttcctgattttatctaccattctcttctttgtcgctgtaggaaccacgactgtacatggtagagacagtctttgacatgctgttgcagcagcaaaaccggcattaccgccagaactagcgaaaacctgaggagatcttttaccgtccttttgaattcgaatggcacttttcatgatgagattaccgattcctctacttttgaaggagccacttggttgaaggcattcatatttcaagaaaaattgtgcagaagcctttccggggaagaattgacgtaataatggtgttttattgtagactatcgacatctcgctggttaattttcctgtctcttgtctatccagcacttaaaaaagagaaaactgtataaacattttccttttatttggcgatatttatatacctgtgatcctcctcatattgtccctttaatcttatctcatcgcaaacaatttgataaagcttggcactattatgacactcatggaattacatttccgctgggacttaacaggagcgcccatgcggaatcatgtctccgcgcagaggactcattagtttccgttcgcggtgattagtactcgcgaaaagagaaaaagaaaaatagtaggaacatttcgcaatgatcaaaatgtaaacagtgcagtaaagaatgggaccataagatagataagaaacagctcgcataaggaaacaaggacacatcgattaatggcaacccaagccctagaggatatcacggagaggcttttaataaggtcgcaagaggctatcttgcaattagatctgtggatacaacgtcagcagagatcatcaatatgccagacaacagatcaagagtcattggataagttatcccaacagtacaaccagtatatgtctcaactgaactctttgtatgttagatcggaatctgttcgagacaagttgagcaaggaacaacaacgcagattgatcacagaggataatgagcatcaacgcatagaagacttggttcgtgaattccaggatatcactttgaggttgaacgagctggccaccgtccaaatgaagcgcctaatgattctccacaatcgcaatccaccagaagtagtttagggtcatttcaacctcgaccattgaaaataattgagaggcaacgtctgtgtatggtaactccatcgaaaccaccaaaaaaatcggtaggctttaaccccatcaatgaagtcgattgtccttcgaaaactaactctttaccgtgctcacctaaaaaacaacctgcaagaaatcgactttacgtgcagccaaatcacatgatactggcttgaacaaaagtaagaaaccgtcttcctcggatacgtatgagtctttcttcaaaaatagacaaagactttcgttgaccttctttgatgaaatggatgatgaagattttgattctgatcaagatactatcattctaccaaacataagtacccctccacatgttggtgtgaccgcaaagggtgctgaattcgaacctttaaggagatataactctcacgaaagtatactatctaacaaaccagcaccttctaagtcgctcaatctgggaagtttctccgcctcattcttcaggccatctaatccgacgtttggaacttcgatatcaaatgtccaagtgaactgtcatccaactgttgcagcgacaatggctcctagtcgtaatggtcctcgtatttcaagttctaaggcgttgttatcatcattcattgcacgatcagatacacatacggtaaaagagaacaacacaaatcttaagcatgcatcttttatggataagtttaattcatcgttaagcacaatatcagaatcttttcaaagtaagagggggagaaagaataagggcatgaatgaagaacgaatatcaaatcataatgtagcacaggaacaaaaaaataatatggatataagcgtctctatagaagaattgcaagatgctttgaatacagaactgctgttttaattaatgcctcctttacctaacctactcttcttttgctccaaatgtttattctttttttttttattcagaatatcttcaagtttttttgtatctttttgtattattattaaacttctttataatatttgtcttataaaatcctatcataacatgactatggcttggcctagactcgggtgccatcttttttaatgcgactacttcaagacagcttctggagttcaatcaacttcttcggaaaagataaaaaaccactaattatcaaagctatcttgtccgctttcaaaaagtttattcgattttgttttcgttttcattttcatttttttattatgatggtcatggtggtagcggtggctcccttcagttttcctctttggtgctattaattttctcgttttccccatatatgtgatagaagcttttgaactccccactgtcttgtaagactttagaatcttgactgtcttgttaccttctttaaacttatcatttatgtctgttctggacgcaaaggatttgattattgatggatgtttgaaaacgccaactagtgatgtatctccattttccacctcatcttcatcctctgggcgcttttctaagtcaattattgtgtttactgtttttgaagtggtcgaatcagtttgagaatttgtgaatgactttatcgaactattctgttttagggtatataaatcttcaattgcttcatcattgccatgttgtatccttgatagctccttatccgtttcaaaatcctcataattattactttttaggaaggataagcttttctgcacaaagtcttcagatatgataacctttttgttcttttgatctacaggtttctgttcattatttcccgtattatcacctacattaatgctattgtcctgagatctaggtcagtagccgtacttgtaatgtctaggttatattcctcttcaggccccggaagggggtttttatattcgataatatcttccaccatactttcaaaaaatgcgctcgactttgggtttttaacaagctttgcatcatcgccaatttctaatctcctttttctcatcaattctctccttttgagacgatattgttgtagtacgtcgtcttcatcatcatcacttagttctagctctaagctattttttgctcttttattacgaaatcctccatttttaatgtcataaagaattttgtttatcattttgatatccatttccttattttctgcggcaagcatttctctgatttcatgaggattgaaattgttcttggaataatcatcgatcattttttctaggtcagaatcatagtcgtcagatccttctccatctgcaccaccgataccatgccattcatcctcggattcttcggcttccatttcaaagaagtttgtgacacctcttttcttcaactcttttatcttagcctcgtgctccttttctttctgttttagttgcaatttctctttgtcaatcagctgacggcgaattgcttcatcagcttcttcattgacgtatacatcatctttgacttcattttcgattgtatttctttcggccatcacctcttcaatgttttgtgtatctagaacattggtttcttgaaatttgtcggtatcctctccgatattatcaccgtaatggcccagattaatggcgatccttttcggtagactttcatcagctttctctttgggtttggcttcgacttcggtatcagagtctgattcgttaatgatatgtttcacgtggtgggattttttttgctttagaattaatttcatcatcttccttttcactatcggattctctacgattgtcattttcactaccagatgattcataatcggcaatttcattaccactcaattgcaaatccagaagactctgaccctgagtcagaaccggaatcatgggcgttcaattgaaagtcattttcttcaagtttttcccttctcttctctttttgtctgattcttttatttctaagaatttcttgttctagcaagttctctactatttccttttctttggccatatcctccagcttcagacctttcgtttcaatcacttctttctgatgatccagaatttgtttcctgctagctttccttaaggtatttaatagtacattatgatcaacttttgggtctttacttttattcggcctttgagacaacttttgattttgtttagagagtcttgccttcaggtttaatatagtcgcctttgataactgagagattggcaaaacgctttcatctttggataatttaatgctatccatatcatcatctccatattcgtcactgtcgctgtcgaggtccagtgttatgcatttcgaggagtcaatttcccgtttcaaattattagcataggagctcaatagtggaacccttttctcatttattcttgtctcatcagttagatttaattcaacacttttgttctcatgcagttcatcgtcattctgtactggttttggatgtgcattttccagctttatatcatcgtcctcatttgaggacgaatcgtcaaaatcagcaagaaaagactctttagaaaaaaattttttggttggtattggcttttgcggttttttgtattcgacatttctagctttttcccttttagaatcttctgaagccaattcgctttgtatttcccgaatttttaatgtgtgtggtacttcatcttgaagtgtttgtgcgactgtatctatttgggttttctgttcctgatgcgtagcctgtggaataccaattgcttgtgtcttatcctcatcatgcgcagtctgtggtggtacatccatttgggtgtcaggaccacgattttgaatggactgaaataaaggactagttccaataagttccgttggaattataggaattttcggcgacagagcattagaatgattgctggaagtcgtaattatttgggattgtggttcaattgattttataggctgagtttgtgaggttgcaccgctgctatctatacgctgtgtagccctggccgtcctgtcgtgagaggtgttttcagcgcttgagaagtttcgttgacgagaccatcttctttgattaattgggtgggtttcccgtcattaacggaatggataggtacgttaaacaccttgtcttgttggatgctgacaggtattctttgcgtctgcgtgaatgaagaagagacatttttctcactgtaactattatctttaacttcggatttctccagctcttcaccaccatcgtcaaagattagagattaattgagttggtaacgaattctcactcctatcttttccattattgtgattctgttcgggtgctttcttgccttctaatctgttcttaacacgattaatgtggcatttgcaaataaaaacccgttcccagtcaactctggcggattgtctatgtcattgggcccatttccattagtattatcgttctcatctagtatgggaacagcaacttttttgtaggtggtagttctcttctttgcagtcaacgaggacaaagcatgcaaggcatcatccatcactaaaatatttggtgataagttcaaaagcgaataacgaacttccttagttgtttgtctgttcttggtttttttccaacataatgtgtttgaaatgctattgaagcaaacgcgttttacgcattctatctcttcatgacgcgtcgaagaaggataaggaaaatttcaagtattgatgtatatctctctgcatatgagagccagtagagttggtgtcctagtaagaatttctttcactttacaaacatatctaagtaaacgaaatgtgtgtgtgtttctatatatatatagacatatatgaaggattccgtagcggtgtaaactaattttggtttggcttgtatgcttcttcttccggagctatgaaatcttttgctctctcttcctgcctttcgatttctctttccatttgcttttccttttgctcatttaatttcttcatttgcttttctctcttgcttaagaaatactcaccactttcaatttccaaatcaacctttctaggcaattgggcaggaggaaatggagtatagaccttcttttcgacgtttctgatcttcttgggtttctttctggccacattcctcttcttaaacatgggcaagaatcttgaccaatcttcattggctaactctggcctttttgccaattctctttttatcattaattccttgatatgatagatagggtgaatatttttcatacaatcttctactactcgacggacctccttcaagcccttgaagggacccatggcacttactgtgttaccttgtactagaatgtaacatttagttagaagttccaaagcctttaaagtattaccgttagggcctacaagacgttgtcttctcttgacaaacctttctttgttagtaacgaaattaccaattttaataacgtcgcatgccatgtcatcttgtaggatcttaacggcttgcgggaaaggaacggatctcgccaataatttgatcaaatctctggctttcaaaatgatagcgggatcgtatgtttttctagttgtttttactgtcatagaaccttcgactaaatctagaacacacgctatgttgtgtttgtctagagcccttgttacatcattccaaatcgtcttcaagtaactttctctgtatttaggaaacaaagtcataaaactggactcttcagcaaaaggttgaccggatgcgttatcctcttccttaaactcctctatcttccatttatcaatatcatccgtatcccaaggtttatctctgttatgtgtagacaccatcgtttgccaatttggatatttgtgtgacccttttgtttgctgtctactttacaatagttaacctcatcatctcttttttttgaaaattttcatatctcatcgctaaaagaattagaaatataaggaaaaaaaaattttcgttttcagatgtgcaagcctgctataataaggtacaataactcaagggcatttagcaaggaaaaaatgggcaagtgtagcatgaaaaagaaaggtgtgggcaagaatgttggtgttggcaagaaagtacaaaaaaagaggtcgatcagcaccgctgaaaggaagagaacaaagttacaagtggaaaagttaaacaaaagtagtgaaacaatgataccgacgctgctgcgggaggcaagtacacaagagccagctaaactgaaagctgagactactttgaaagccgaggagctgatcaaggaccaggaaaaggactccaaggtacgagagcaaattcggacagaaaaatcaaaaacaaacgacagcatgctgaagcagatcgaaatgatatccggcttttccttatagggaatagtggtgaaagttacgtaaatatatacatatagagcggaatggtactgcatatttttattatttttttttttgaatatatataaagcatcgtcgcttaagactaaaccttcgaggatctgaggccagcgctggatctaaagatggcgtcgccctcggcgtagcctcttccaacaccaaatccaatgcctagccatacaggaaatgcacggcgcttgaagaataatactgaggtgaacacacccacgccaaaacccatggcagtcttgaccagcatgttggacaggacaatatcccacttagtgtcgaggatcgtggacacggagctgccattcttgttagaatccttggagggagtgcttttcgctggttgttgtgtttgtgcttgttcggacatggtatattttgtctttttccgtgtttattccctctcgtagcaaagttaatctgccaattgacagtagtttaatatatggtattatcgttgtttgaagccctttaaaaggaaaaaacgggttagggccacccggcgcgaagtaatagctgctgattggtcagaatagtaaaacggcttgaattgatagtatatcgtactgtatataccttatatttgggctaataatcatctcccaaatgctccagtatacatgtcacctagctatgtatgaggttgactaccttatatgcagctactacacaataactgtagtatcgcgctgcacgagcgtgacggcggttaaatctggattttttgccaccttttttatacgaaaataagaactaggtaaataggaaggaatggttggatttgagtttaaaaatagagggaatacttggagatgcgattgttgctgtgcaagaattggtttgcgtcacctgtaatctcaccactactgtatacccgctccttatattcaatggctaacactactagtttccctattgctccccaggccccgcctaattggtcgttcactcccagcgatattagtgggaaaaccaacgaaatcatcaacaacagcaacaatttctatgattctatgagtaaggtagagagcccttccgtgagtaattttgtggagcctttcatgaagtttgaaaatgaattgggcccaataattaaccaattaactttcttacagcatgtgtcgtctgataaagaaattagggacgcatctgtgaactcctcaatgaaactggatgagttgaacatcgatctatctctgcgtcacgacatctttttgcaattcgcccgcgtctggcaggatgttcaatcgaaggcagattctgtggaaagagaaactttcaaatacgttgagaagtcttacaaggactacattcattctggtttggaacttgacgagggaaaccgattgaaaatcaaagagatcaaaaagaagatctccgttaactctattaatttttcgaagaatctgggagaacaaaaggaatacatcactttcaccaaagaacaattggaaggtgtgccggattctattttgacgcagttcgagacaataaaatctgacaaagatagcaatgaaaccttgtataaagtcaccttcaaatatccggacatttttcccgtgatgaaattggcatcctcagctcagactagaaagcaggcctttttggccgaccaaaataaggtccctgaaaatgaagctatactgttggatacattgaagctgcgtgacgaattggcctcgttattgggctatgacacgtatgcgaactacaacctgtatgataaaatggctgaagatagcactacggtaatgaactttttgaatgatttgaaggacaagctaattccgctgggcagaaaggaactacaggtcttgcaagatatgaaagccgaagatgttaagaaacttaaccagggtgcagatccaaactactacatttgggaccaccgttactacgataacaaatatttgttagaaaacttcaatgtggacctagaaaagatttctgaatattttccactagaggctacgattactggtatgctggaaatatacgaaacattgtttaatttgaagtttatcgagacgaaagattctcaaaacaaatctgtttggcatgacgacgtcaaacaaatcgccgtttggaatatggatgatccaaagtctccaaactttgttggttggatttatttcgatttacatcctcgtgatggtaaatatggccacgctgccaattttggtttatcgtcatcattcatgattgatgacaccacaagatcgtatccggttactgcgttggtttgcaatttctccaaatctacgaaggataaaccttctctactgaagcataacgaaatagtgacctttttccatgaattgggccatggtatccatgacctggtgggacaaaacaaggaatcgaggtttaatggccccggatctgttccatgggattttgtggaggcaccttcccaaatgttagaattttggacttggaataagaatgaattaatcaacctctcatcacattacaaaacgggcgaaaaaattccagaatctttgatcaattcattgatcaaaactaaacacgtaaatggtgctttattcactctaagacaattacattttgggttatttgatatgaaagtacatacttgtaaagacttgcaaaacctgtcaatttgcgatacctggaaccaattgagacaggatatttctttgatttctaatggtggtacgttatccaagggttatgattcatttggccatataatgtcagactcttactctgccggttattacggttatctatgggcggaagtctttgcaactgatatgtatcacaccaaattcgctaaggatccgttaaatgccaagaatgggatacaataccgtgatattgtgttggctcgtggtggcctttatgatattaatgataatctgaaagaatttttgggtagggaaccttctaaggatgctttcttgaaggagctgggcttacagaactaaattcgttcaagcataaaattatacaattattctacaaagtgttattatgttagataatcttttaaataacctcgtccctggatagattaaaaccattaaatagctcaaatcttggagtaaagcagcagtaatatgtctgatatgttcgttatattttttcttgaagtttatcaacttatcctttactagaccatttccctccccatccaatcgttgatcgattttaaatttcaccttgcataattttattaatttccatacacattttatcactgaaatgcacgagtaacacagccaaactttccgtaatagcccacttacatataacttatcgttgaccacgcctaggttttccaatactgcgaagaaatcaagcagcgaacttacaccactccatatattctcccatatatcttttgcactgatttcagccgtatttttcttcgaaaccattcaactttcttttcttcttcctttacttttattcatctcctctttacttcttacctcagagtcgaacattgaaatcatttcccgcgaatttttcgattataattaccctttctacttaacaagaagcaataagagcaaaggggcgaaatgcttgtcccatactttggcttttggatgtgacattaggagccttatctcctcttaatgccttaagtcaaaaaatagtttttgggatatatcttgtgatcaaatgctttgcaaaagggtaaaacagcgtttacaataggatagccaaaagtaaaaaaaaaaaaaaaaaaaaaaagaaggaagttagtatcgagctcaaacaattttagttttgctggacatattttcagtttcattactgtatatttgcagcttggtttttgtcgctctgtagtcttgtttcacacttcgtcatttccgagtttcatcttgcgacataacttgtttcaacttttcaagtgcgactttttgttaaatattatgacatagaagaaagtagaacagccattataaaacaaaagagaagtgagaatactattaagatggcattccaagatccaacttacgaccagaataaaagcagacacatcaacaacagtcacttgcaagggccaaaccaggaaacaatagaaatgaaatctaaacacgtatcattcaaaccctctagagacttccatacaaacgattactcgaataactacattcatgggaagtcgctaccgcaacagcatgttactaatattgagaatagggttgatggctatccaaaacttcagaaattatttcaggcgaaagctaaacaaataaatcaatttgccactacgccatttgggtgtaaaatcggaatagattccattgttccaacgttgaatcactggatacagaacgaaaatttgactttcgacgtggtgatgattggctgcttaacagaaaatcagtttatttacccaattttaacccaattgccattggatagattgatctccaaaccaggtttcctgttcatctgggccaattctcaaaaaatcaatgaacttactaaacttttgaataatgaaatatgggctaaaaagtttagaagaagtgaagaattggtttttgttcctattgacaagaaatcaccgttttatccaggtttagatcaggacgatgaaacgttgatggaaaaaatgcaatggcactgttggatgtgtatcacaggtacagtaaggaggtctacagatggacatcttattcattgtaacgtagacactgacttgagtatcgaaacgaaggacaccactaatggtgctgtaccatcccatttgtatcgtattgcagaaaacttctctaccgcgactagacgattacatattattcctgcaaggactggttacgagacacccgtcaaagtaagacctggctgggttatagtgagcccagatgttatgttggataacttctcacccaagagatataaagaagagatagctaatttaggttcgaatatcccattaaaaaatgagattgagctgttaagaccaagaagtccagtacaaaaagcacaataaagcatcaacacataaatccttgcttagctcaattaaatatactagtaaataagtatataaacaataattttgcattttattttactggaaactcttctcaaaaccaaattgcgcaaggattgattcagtacaattatgcaaactcgaaaagtaaataaacaaaaagatacagttgagtgaaaggtaaataaacattattctacttgattttcctctgttttttccatttttcttttttgtcttttcgtgttctagcgtgttcactttttcagccatgtaattacttaaataggaagtttacacgatgttctcgcataaaaagctggaagtgcagaacaaagaggaagaaaataggaacagagaatttgtttgtttatttgtttgtttgcttgtttgtttgtttgttttgatttgaagtcgaggtacttattcgaaataattattttgcccagggttttggatagttttttgttttccaattagatttttagaaatattttatcatagttttttgtttatttatttgtttatttatttgttgatttgtttatttatttgttggtttgtttatttaagtttgtaaatgtttaataaacaaaacaatatttgcaagccattgaaaactttgtaaatttgtttgagaatttacgaaacaatgaaaattaaggactctttgatggtgaacgaattactactttgcagcaggtaattctctaaaactcagaaacaaggcatgtatttttcactaggaaaaagaaggaaaatgggactacagtattagggaaacaggattaaaattcgtaggtaataataacccatactttcattgtagcagtactttcgttaataaaatggatattgttgtacttcggtagatgttatattctaaagagttaaattatccaattccaaattctagggacggtttccaaagatttgtattgtccagtgacataattttcactaaaacattgatctgtttaataggtttgctataaatgcacaataatttttcacccatgatacccaatttcaagagaagcaattgctacatataattatttaggctttactatctactactcattgactgtgcccttttacacaattataacaaatatgtcaaagcagatgccatgaactttgtatctgaatttttgatttccttttaattctaattgcagacgacgtaaatatagttctgaatttcaaagtcactgttaattaattgttctaattgtttggtttttttaatataaatcactagtgcttaagttctgttgacgcacacagtacctatctttgattccttcgtgcaaacagtattccggcacgttaattgataccaaaaagatttcaaaatcagatgcttcaagactaattgtatactttatgtgacttctggagtttaatttgttgtattgatgagataatattgtctattatattgccaataacaaccagcgccaggtgtactaagtcgagatgacagaaaatttataataagtgtaaatacaataaattttgtaaataaataactacttcaatagaaatctcaaagtcgaagaaacacagaacacagaagtaaactggactaaatgattttcaataaaggaaaagcacgaaaaattttttgaacttttttgggacagcgtggatcgtgtaattactgtattgggaaatttacacgattctcgacaaataaagaaaaaggcgcgtttaaagacttacaagcacacctttgaattatttttgttctctatgattatcaaatgtgctagtgtttgcaagatggtgcttttttttctttagattgccacgtttctgctcctctttgtggttttctttttttttttcaatcttacttataaaatgaatatttcaattgatgaatagctatatattggatacaaaaattagcatttaatcgaaaactgcagcatgtatttaatcgaaaactacagcatgtagctatgatacgacagaagatttttgtttttatagttaagtcaagaagaaattctatttgtccagcaatccggcgcaaagaagactactaaagggtattgaaaaatttctagaaccagaaataatcgaaagcattactttttttggctctataaaggagttctggacagcttgaacttccgaagtctgtctgtttagctcgttaagataaatctcaaaagagtagcaagcaggtgggagggataatttggattaaagtgtatatattgcgtatatatagccacgtaaacctcacactattgagtttaaacatttttcaccttacgttattattcttttgtctaattttaatctcctccagtatactaaaaccgcaaaagcgggttacccagcttgtttctttttgtctgaaaaattttttgcgatgcccattatgaaaaattggcaataatagtatagtagttagtttaagtttagattctttcaatactcattctgcttcagtttgtagttagatttaactcaatagaggtgattggcaaaaatgggtaagacacaaaagaagaatagtaagggacgtttagatagatactattatctagcaaaggagaaaggttatcgtgctcgttcatcctttaagattattcagattaatgaaaagtatggccacttcttagaaaaatcgaaggttgttattgatctgtgtgctgctcctggttcatggtgtcaagttgcatccaaactctgtcctgtcaactccttaattattggtgttgatattgttccaatgaagccgatgcccaatgttataacttttcaaagtgatattacaacagaagattgtagatcaaaattgaggggttatatgaagacttggaaagctgatacagtgttgcatgatggtgctcctaatgttggtttgggttgggttcaggatgctttcacccaatctcaattaaccttacaagctttgaagttggccgtcgaaaatttggtggtgaacggtacttttgttactaaaattttcagatccaaggattataataaattgatttgggttttccaacaattgtttgagaaagttgaagccacaaaaccacccgcatcaagaaatgtttctgcagaaatttttgtagtgtgtaaaggtttcaaggcaccaaagaggctggacccaagattactggatccaaaagaagtttttgaagaattgccagatgggcaacagaatatggagtccaagatttataatcccgaaaaaaaagttagaaaaagacaaggttatgaggaaggtgataatttactgtatcatgaaacctcaattttggattttgtcaggacggaagacccaataagcatgcttggagaaatgaataagtttacaattgatgagaatgaccatgaatggaagatcttgaagaaattgaaacaaaccacagacgagttccgttcctgtattgaagatttaaaagtcttgggtaaaaaggattttaaaatgatcctaagatggagaaagattgcaagggaaatcttgggcatcgaagttaaggacgacgctaaaacagaaattgaagtagtaccgttaacagaagaggagcaaattgaaaaagatttgcaaggtttacaggagaagcagcgtctaaatgtcaagcgcgaaagaagaaggaagaacgaaatgaagcaaaaggaactacagagaatgcaaatgaacatgataacccccactgatattggtattgaagccgcaagtttgggtaaagaatcgttgtttaatttgaaaactgcagaaaagactggtatcttgaacgacttggcgaagggtaagaaaagaatgatttttacagacgatgaattagccaaagataatgatatttacattgatgaaaacatcatgatcaaagataaggattctgccgctgatgcggacgatttagaaagcgagttgaatgccatgtatagtgattataaaactagaaggtcggaaagggatgccaagtttagagctaagcaagcacgtggtggcgataatgaggaagaatggaccggttttaatgagggaagtctagaaaagaaagaagaggaaggtaaagattatatcgaagacaatgacgatgaaggtgtcgaaggagactccgatgatgatgaagccatcaccaatttgattagcaaattgaagggacaagaaggtgatcacaaattgagtagtaaggcacgtatgattttcaatgatccgatatttaataacgttgaacctgatttgccagtaaataccgtcaatgatggcataatgagttccgagtctgttggtgatatttctaaattaaataagaaaagaaaacatgaagaaatgcaccagaaacaagatgaagcagattcttcggatgagagttcaagtgatgactccgatttcgaaattgtggccaacgataatgcatcagaagaattcgattctgattatgattcagaggaagaaaaaaatcaaacaaagaaagaaaagcattccagagacattgatattgctactgttgaagccatgactttggcacatcagttagcattgggtcagaaaaacaagcatgatcttgttgatgaaggtttcaatagatacaccttccgtgacaccgaaaatttgccagattggtttttagaagatgaaaaggaacattcaaagataaataagccgattactaaggaggcagcgatggcaattaaagaaaaataaaggcaatgaacgcccgtcctattaagaaggttgctgaagctaaggcaagaaagaggatcgtgccgtagctcggttagaaagatcaagaagaaggcgggcttgattaacgatgattcagacaagacagagaaggacaaggctgaagaaatttctagattgatgcgtaaggttaccaaaaaaccaaagaccaagccaaaggttactttggttgttgcctcaggtaggaacaaaggtttggcaggtagaccaaagggcgttaagggtaagtataagatggttgatggtgtcatgaagaatgaacaaagagccctaagacgtatcgcaaagaagcatcacaagaaaaagtagtaacaaagagcattatttttccattcccttgtataatattgaaaataaaggaaaagaaagcaatagatatattatgtatacatagaattaatcaaattatcatcaaaaaacttataggaaacctatcgttttgaattcagaaaatacgagtgcacagtagaacaatttttattcccgttttactgatcttttcttcttgttgttaccaaataccttggagaaaatgtatatgatggagatgagtaagcatagtaacgtaccatttttgatcttggaataatcctttgtgtcaggccttggaattggtactagaagagttgtcgagttcaaatggcggaatgtagtatcgtctgtaaagagagattcatatcctagaccttttttataaaatggattacgggaaactttattgtcacctgtgtcgcaggctaatataacttctggatcaaatgaaacttctaatttatcccctttattattagaaggctcaatatatctagtatgcaatgtcacttcattcattgtgccggctttcaattcaaagatactttcagaaccccatgccttatctcgaagagagtattctggtaattctaagtcgtcttctccaaaaagtagtaagggagaggattggaatttatcgataaataattctaacggcaattgcaggtgcattagatacatgcatttagggcgttcttcgaaatctgtgagatcaatcatgatttttggatgcaaaccgataggttcattcagatatagtgatgtcgtagtcgtcgagtgattgtatgcgatatggccctgtttatacaataaggatgttttctgacatctttccattttaccatcgtccatcctccaattacaacgtattccaccaatatcgacatcactttcatcacttgcatccacaaagaatacacctacttcgagtttctcatctttcactcttgcaattgtaaattcttcaccctgtttcaacagacgatattcaacaatttggatttgtgtgggctccactgatatatcatatgtaaaatcttctggattccatgacagattcaaatctacttcgggaggcaagtactgctctatgtcaaacttctcactgtgaaatgaattgtagactgggttagtaataaacctttccggcacatccgaagaatttgagtaaactgaaaagccagcactcagttcattttctataacgcttaaacttctagccaagtccgctctgggcctccaagtgattctcgtaaaggatttatccaagcttccagtcctctctaatagccacctttgttgtaaaaccacaccagaacctccacgaacagtcaaatgagtgtcattttggcgcatatgattaccgatatcctcaggggcattgtagagtacagtcactctatgtcttgtcaccattactcagctagaaacgcacacttcttgcgtttattctcctcccgatttgattatgattagcgtttccattatttgatcttttttatcagggggatcttcaaagaaaggaactttttttaggaaaaaaaaataatcatcttttattacatgtgtaatacttcaagcaatcataaacaagagttaagaaggcaagtctgctgtagtgtgtcctccaatactcttgcacgacaaagttttagttatccccttctacgtgtattgttcctccgtggtcgattgtgttcaaagattgggagctcttttcgtgttttgcactaagagcatactgttaatccgcaaaggccactaaaacttacctgcatttgtctacttaaagatacattccaactatttacattcatttttatttctaaaagagcattctgaaccctcggcaattatttcatactccttctcagaataggaaaatgcccaatacgcatactcaacatgtgcaaatatcagagccaaatcctgtaaatactttgtctacaccatccaaaagaggtcaccgccatcgcagatcgctagcaatatcaggagattttgattttttgaaacagcctgcagcaattgtgaatttaccacctccacaggcggctgaaaattgtccttcaactgccccaactgctgtatcaagtacattatcgccaatacgctacaatagatttccttgcaaaaccaatgaagacgctggaacgttagatttgcctgaaccaagattttatccgttatcaccaaagaacaatctgcaaacaccaagtccacgatttttcattagtgaagagccaagtttttcatcgccagttaaaggcgtcccagatgccattattaaccttgacgatgcgttgaagacaaggcctaggtcatttaaatcacatagaagatctgaatccgctcctcctgatttggaggttatggtagataagggcaattgtgcagccggttctaactctatgattaaagaagaagaggactccttaattgaaccagaatcgaaaaatgaatattatgagcaaaagcttccaacagcactattatccccactgcggccttccctttgtgtatctgaacaggccattgatgtagatgattcagctctcaatgggtcaccgacccatcacaaccatgggatgcaaaacgccaatgcacggaattccaacacattcaattcgttgaagatcaaaggccaaaagcaaagatattatcattatacgaagcagctacctttgaccgtaggctgtgactcgcaatctccaaaagaacaaaggtcggctgcttcaatgacaatcaatcaggcaatgacaccttcttccctggcctataccccttctaaactagcatctactcccgcaacaccagtatccttttatgacagcaatgcggacattaacttagaaagtgataattttccactaaaagataaccctagatatgccaaggatggttatcctaaaaagtgcggcaattcacagcttaatcgtgtgctggatagcgataaaagacaggattttagtggagaatcgagaagaagaagatcgggcagtcctatctcccacatgcaacaccgcaacctgattgataatatgaaaggtagacgaaacagtaacacgataaactcaatcttcaactacaagagtcaacattatgaaatgccatatgatgatatgatgaaaaatgaaaacattaatgcacagtccatgcccttttcagtcaacggtgtcaacaatgaaaatagtatcggaggggttattacgagagcggacgatgcaccccttcaacactctgtggtcaaatcctgtacgcctgatggcaaggaagaaatgaataggcttaaaagtaatgacagtaatgaatattccaagtctgaagggcagatcagaaccaattcgcaactaagtaaggacattctcatgggtgaaccaggtgatatggttgatctgtcctcttttgtcaacacgcagagaaaagcctcaaatgaaactggtgacttagtctttagtttatcccaggatgatgacgcactgaaaacgttccatgcgagcaatagcgcagcaacaagcaatgaaagctggtgtattagcgatggtgcgttaggaaagcaggcgcaggacagtgaagttaggaggaaagaaatcaaattaggactctttagacatattttcaaggaagtaatacaacaatattaataataagtaataaaaaggtgaatcgtaaccttagcggcattgattgcatgtagttttaataataaagtgtagaataataaatataaaatttcaaagtcattagaaataaaaattgaatagacatatacatatagaaattacttctatcatttaaatacatatatatatacatacatgtatacgtgtatacttgtacttgtgaaggactcaatagttgtattcgtttggtttttgaccagaagtgtttgggaaaccacattccaataagatatcgttaatcaattcaggtttttcagtaatcttggagaaaacttcatcatttttggttaagatcataccacaataacctgtggagttgaaacctatcttcatttcatcagaaaaggccttcgaacgtggaacgacacagatccattccttggttaacataagattgtaggatttctttagttctggattttcgttcaaccagtcctggaaaaaggtcaaagctctttgcaatatggagatgtaacacatagctaataggtcttcatcaacagtttcttcggactccggcattggcaagacaaaatgagcgaacgagactttagcatcttgcaaaggttcagtattgaaagttggtaggaaatgttctttaccattacatagtctatcttggaaagtgacgaacttttcaggcatttgcaaaatttgcaaatgtttgtggtccaatgaagaaccactggctggaccagaattgtaaaagaccatgtgtctcttgtcggattcttcattgtccaaggcacacagcaacttataagcagtcaataaatcggttggggtcaaggcatcagtttgatgttggtattcgttagttaccaataaagtgtgtccagggattacagggaatttgtttaatagcaatttatacgctttgttatcggcaccaccaaattctgggataaccgttaattcttcctcaggtttgcctagtggatcctctccttctggagtttggccacgctctggcttttcgatcagacttggcatgtggctaatcaagtatggcatgctggtttttgggtcctttgttttcgttgtttcagtctggataaattttaagttaccattatcgaaggcacttttgtacttgtcactaattaaagatgcaatgtcagcggggatactcatttttattttaatgtttacttttctgtttgttctaaaatctatctaaactggctttcaagatcaatctattgtcttttaaggtaaactttaaattggaaataatagtaatgttagttccttcattttaaccttgtattgtatttcctttgcgtgatgaaaaaaaaactgaaaaagagaaaaataagaaaatcttctagaacgttccgaaacaggacacttagcacacaaatacagaataggaaagtaaaaggcaatatatgaatgcagtgcttgtaactggtgcttgtatccaagaatagcttcttgctgtaggttatgggattatcgtgtaagctggggtgacttttgagctattcgcgacgcccgacgccgtaataactactttcgacagaccacttatgacagtatttcaggccgctcttataaaatgacatgttaacaaacagttctgattattcgccttctgacaggacgataatgtaaatagttgtggtagtatcattcaggtatgtaactgtttacttggtatcgcttgaaaaaaataagcatttcagagccttctttggagctcaagtggattgaggccacagcaagaccggccagtttgaatgctcaactcttcaaaagaaattcctcaaatatgtccagtttcatgtactgtccggtgtgatttattattttttatttactttgtagttcttaaagctaaggtttttttctttcctaaattcttgtttaaatatcctaaaactaaagggaaaataaacaatacataacaaaacatataaaaaccaacacaataaaagaaaggatcaaatactcattaaagtaacttacacggggggctaaaaacggagtttgatgaatattcacaagataaaaatcatatgtatgtttctgatatatcgatatacaatcaaacactttcaagaatttgtttgtagactttttgctagagacctcatcaaagtgctaccaactaagatcaacttatacttcttttagagaaaatttttttcaatgtactccaaagagatttagatcctgtctcttcctcttcctcttcctcgaaagtcaaagaaaaatcagagtctccctgcttattcaggcggagaggctctagggtagttgcgtttctctcattgggacactgaacctcattttccgacattttggtcatgtaagaggcgacaggctcatcgcaggtaggtgcatcaacatggtagtacctggaccaagcgctacattgagtccctcctggataaacaccgctacaatattgtctttgaacgtttgcccaaaccatatattttgaataccaaagctggaccacattgtatggcttaatcattggtgctaccataatactggattgggaaacagtctggttaattttattcaaccaatttttcttatctagcaatgatttaataaacctgaaatctaaattgtcttcgttagcgtctgtgtcataatctacaattgagtactgtgacgtccaattatatggcaccgagatggggaatctgtccggtgtttcgtcgctgttatccttctcctccctccaaatgcagtcagaggcaggtgcccattcggttcgccagtctccgttatttactacttggtactgttcccaatcgtaatacgtttcctctgggttgaagatacttgctctgctcttgacattgcccatagccacaccacgagaaacatcgtggaagattacggagctgtttacgatagcaggagcaatggatttgacgaatgacacttgataaaagtctttggtcgaaaatacagtatcaacgccgtcgtgggactcgacccctggtagaagaagcagagcatctagatcaacggtagatgctgcagaggtcaaagccacaaagagggaagatgcagttacgaggtatttactaaacattggttcgaagtgattacagatttttctctcttgaaccctggaattgcaatagcttggttcctattgggaccggaccctcttgcgtaaagtatatatttagaagcagctatttaaatctgaatgcaagacgaaaaaaagctcgtttataggagaaaaataccaaaaaaaggaaaaccatacacattcgggtatcccagctttgcttgcaaaatcaatcgatgagcaagacaaacagggccagctgatgcatatgttttgtgttgctttcctacgatcagctaatgcgagtgttataaatattcccctagttttcttctcctcctttatgtaacaataacttgtggacttccccaacataagactaaaagcaaagggataacaagggatttatcttattccatccctttgcctagcgcactgttacgcagctgatcttatcaacaagtgtggttcttgcctctaagatttacattgccttttcccaaagggaaggtgggacaaaactcattttccctaaggggaaacgtaagataccctttagggaagataagggaagttagtagattgacgacgtaaatctgtgatgagatgaaaaaaaaagattagcatctatataagaaagtacataacctccatttaagttgaaaaaaatttgtatgtaatgtcttttcttcctcttttctttatttcattctcaccgctaaatcgataacggctaaaacaattaaagctcccttttcaaaccttatacttccgttaaataatgcaaatcaaaaacattgtcgctgttctagctacagtcactgctatcaacgcccaagttggcattgaacctaacgccactactccaaatgctacgcagccaaatgctacgcagccaaatactactcttcctaccgcttcggtgactacgacagtttcgattggcgaagccgtagttaataccatggcggcgggtgcctttggagcagcaatcgctgccggtgttgccttcttattctaggaacatttttatttcctttatttttttctttctttctaattccataaccgttgttcaaaattggggagctttttaactttcgttccattaagctttttctttgttctttacgtttgattctatttcaaccataatttattttttcgttatttaataattactaatatttaatactagatgtatatacgttgtgtgtatgcgctactatagtatagcttaactgttttattataccctttttttctctctttactgtacagaagatgcgtcactaattcaaaaaaaaaaaaaaaaaaaaaaatataaaaaagaaagattttggagaagctatatccttttgtgacatacaatagagaaacttgttctgttggtaagatatctcatctgaaatacaacaaggaaaaccaaaagccattttttcattacttgatcgacttatgaaccgtattactaggaaaagttgtttattcgcgattatatttgcatcattatttgtgacacatgcattgggtgccgctattgatccgccaaggcgaccacataatgtgaagccttttcataacggtaatctcgaacttcaaagaagagcaaatgaaccgttttttgaaatagatgtcaagagtctgaacacaaactcaccgatatcagagttgtgtaaaaaagatttgcacgtcattgaatcgtctcatgatctttttcatttacaaaaccaatgtgaattcatcttggggtcattaaaagtcacaaactatgattctaacattttggatttgaacagcttgagggccattggtggtgacctgattattcaggattcacctgaactgatcagaatccaagccgggaacttgaataaaatcgaagggctcttccaattacagggactaacctctttggtttctgttgaaattccaactttgaaattttgtcagtcactggagtggaaagttgttcccatcttgaactacgtctccatggattctcagaatattgagattataaaggatattgtcatatcggatacttcattagcaaacatcgagaatttcaacaaggttcaggaaattgatactttcaatatcaataataacagatttttagaaactattcattcgaacgttaaaaccattaggggacaattcagtgtacatgcgaacgctaaggagctagaacttgaaatgccacacttgagagaagtggaaaacataacgattagggacacatcattggtctaccttccacaattaacaaaagtgaaaagctctttagagttcatcgaaaattacttttacgaattgaacctgaacaatttgcagaagattggtggaacattaggaattatcaacaatgtaaatttaataaaagttaatttggagaacttaacagacattcaaggtggcttgatgatcgccgataacgaatccctcgaggatattactttcctgccaaacttgaagcagattggaggtgctattttctttgaaggttcgttcaaagatatcatgttcgatagcttgaaactggtgaaaggtagcgcttttattaagagttcatcaaacgtgttggattgcaataaatggacaaacccatcaaatggaagatcaatcatcaggggtgggaaattcacttgtatttctggtaagaaggaaaatacgctgaatgttaaacaggatggtacaatcatagaaaaagggtacaaagatttaacgcaagaaggtgaagactccaagaaaagagtgatttcaaaatacgcgaactcagcaaatccaagcatgcaattggacccccttctttttggtacatgccttgttgctatgttattgttttaagattactagtctagtataacagaaagttttttttgttcctaatattatctttatctatatacatatatctccatgaaaggcatttgaatttctatctttctctttcaatcaaatattgtcttattattgatcaaataatcgtatatgcacaatggcaactcgtctttcaaactctccacttgcccattcttcagtttgttcctaatctcggatgatgaaacatttcttaatgctggataatcattttgcataacatgaatcctagcgccccattctcttggtattaccggttcgaattttccctcaaggatgtcactggcgtatcttagttgcgattcagcactgagatggcaatcgcctctcgccaagcaatataattgagatcccgacatgaagctctccattacatcactgatttttaaaggatgataatatttttcatcaaagatcctagcaattgtatcaaaaccaactaagtagcctatatctgcactgcatcctttaacaaattgctcatgtaatattttgtccttgtcgatgaatttcgagaaaacagtcaacccgacagatactacagattgggggagcttctcctgaaggtagtcagcgaataagcacatcatttccagacgagttggaaaagatgccggcttaggcaacttatctgcattattcaccgctaacagtaataaaacatgcgaacgggtgtccttcaatttgaagtttttaatagtctgcgatagtagttgaaaatgggccagatgtggtggattgaatgaagaatcaaggacaaataacttctgacattctagatgctggggtcctttgagaacctgaaatagtaaattgctttttcgaaactgctcgaacgtcttcttcatattagtctgctagtgcacgtactgctatcaaccgtcattgattaagtgtccattttccaaagaagtaggagattatataaccacgagtatgacgtcttccagggaaaaaaaaaaaaaaaaaaaagaaagccaaaataaggagccttgaaatgtgtatctgatatatataatgtgtatgtaaatatctatttaattagccattgggatttcaacttcttgtttgaaacagaaggacggataaaatacgtgatcaccaacaagacgaatatagtaataagcaatttacccttttcgaaagtaggactcattaaatcaaattggcccgaaggtgtgatccttgtacaaaatacatcaaggcctagatcacatataatgcttgtggattccagattggttgggatggagatcaactgcgaatcggatcctggcaatagatttctgaaatgagtgataatgaaattatcattaattgggataactggcgtgtatggggtagccataaactcttttttcttatccttggccatttcttctgctggtttacctcttgcattcaataaaagctttggtatgtaggtgatttgtccattttctaattccataacgattgcctttgtggtaatatcatccgttgtcttggaaatggacattgttttgataatctcgggaaaaatgaattgtttagtttgaaattgaggtttgttaatgtgtccagtcaatggatcataagaaaaattgtcgcttgagttagacaaacgctcatctggggttagtgactcatataattccaccactactaacttttgttctggaacaggttcagaactgaaataggaataaacgacccaatattcaccgaaaacaatatccattggaaacctaaaatccggagaatccttgtgctcttgggtaatgaggatttctcctgtaatggtatcaattaagttaaaagtgattgtatgatgttcttcattagcgatcagataagccgctaggttggggtacaaatatttataaagaaccgatttgtcacctagtgtaataccaagagtgtttaggtttgttgtttccctcttgctatatgccaccattttctctttcgaatttacggcttttttccaagtttgttttaccgtatcgttttcgattatgtagccataaatgccattcgtgtcatgctctgtgacgaatatgtgggaactagaatggttgttggcaactattggtacatccgtattcttgccgggattcaatttgaacagtaaatgatccttatcctcaaacttaatcagatactggtgatcatgttcattcagcctaataacggaatcaacagttttcctttcagataggggggatcttgatttgataatcggttgatctttagtaacttcaattgtcaaataatgcccatcatgcgaaaaaacaacaagttcgtcatggtttttatccgtccagaacattttgacgccctgatcaatttctaaatcgagtttccagataagttggcccttattgaccatatcaaggccgccgataaagccatcatgcgtcaaaacaattaagattttggcgaatccgaacttcaaatctgataccgtggtatccttagcgtctagagctaggagtttagtgaagacacgtcctggtgagaattggttttctttcaataagttgataaggcgattccaattagttgtcaatctaagccagtaagcattccaaagcgaatttgaatcaagttccgctttcatatctttgttcaactccacatccctagaatcgaagacgtccaatacagcatagtctaccacgttagtcaaccattcatctctttgccaaacggggatcaattctgtgccattggcagagaatcccatatattgggtatcattaacgttcaacactaacgccaggggatcttcacgatgaaaatattccactttattgaacccttgaggtaactccaatttccattctgccagttttgactgctcatcgagaatatgtagttcattgttcttaatagatacttgatcgtttaaatatgaggattgaggtaaaatggtcgtagaaggggcattatctacgccttcctctagtaaaaaccaatcgtgtaaatcatatttctgccaatggttgcttgaagagttcacacaaaccattgcgttatggtcattactatccagttgaatctcatcaatggtaaagggtaaaacgtttctgaaaagaatctgtccggaagaaacgttaaacgaagaaactaagcaggaagtttcggtagggttcgataagatgagaaccctgttgcggtctcgagaatcagggatgactttctcccaaggacctaagttagccagttgccaatcagtgataaatgcatcatctgaaaaaacggcttggacacaactcgtgtttaggaagagtaaaatgaagacgtacaccaagtctgtacacgttatcttcattgctatgggggaaggggaggatgaaagtgttgatatgaatgtaggtattagttattaatggagtgtatatatatatatgttattatatatttgcatatataatatgaaatcccagccatattttctctggtagccgtctgaaaaatcacggtgtacgaagaaggatttaatatacgcacggtacaactaagcaatccgcaaagacctaatgtgtcttttcattagtgagagccttgggggtaggccctggtaacggctggtccgtgctagtgggtgtcttggtatgggagggcatggtagttggtatgaatttgatgcttagcgaagtttctaaggccaaagtcatccatggatcataaagcgatcttattgtatcgagatcaatatcttgcgggcctttcgtgtcatggggcaaaatgacacctcgggagagtgtggtgctggatctcttctttactggtgcggaaatggaatctcccgaagatgctaagaaatgcagtcttttttccacattttgtagatggagttttttggactcggaaagaccttcaaggccagtagaagaagactgcggattgtgggatatggaattgatgagttcaatggaattttctctaatgtttcttttattttgaaaaaactcgaacatgtccaagtgaaattccatgcgattgaggtactcgttgaaagacatgggcttgtattccaagggtccgaaccatttaataatgggattctgcgcctcaacttgcgctctagcgagagcgacgctttgtttgacctcagggatatttgtcgagagaggagtaccgttcatagcatccttgacttttattttggtggggtctatgccctcgtgataatatttgacaatattgttgaaaaacttcttgtcacgtacggatttcatttcgtcgcaccaggggtcgtatttaagaaagttcaggcgagtaagctccaacagtgactgagaaagtagcaaagagccaaacaacccccataagagctttctgacgctgacgaatcgagattggcgaggtatgatgggaggaggggcgagcacaatgtcaccatgggtggtggagaagcggttcaaagttggaaagtcagcaatatcctttttgattttagtcttgccattgacaatcatttcactgggtagttcgccaaaggataaatccgagtgagtgccagtggcaatgcggcgcggtggcggtagtttgtagagccttctcagtctccaaagggcaaagaaacccactgcagattggatagtgattagagtgtatagtcccggtaggttatcaggagcgggtacgagcggaccccacagttttaagcctaaacttggccttatgtagaatttcttgatatcattatcatctttgtcgtggtcatcttgtgtgtgagtatggtcggtggaattgctattacctgatggaggagtaaatacagccatcttttattacggtaattggaaaaggagagggaatggaggaggatgagataagtagtttcctaagcagtaaagcaagtgtccacatttaagtaaaagacgatgccatgcacttattattactacgtggtcaattttctctttccctaaggcgttcgtgcagtgtgacgaatatagcgaacaactattgtgtttgaattttaacgtttatctttttatgatttttttaaaaaaacttcctagaaaatttcttatatatctctatttaatgaaaaaccaaagtgatcagaattacaattcatcgtgaatggcatcttcttcgtcagccaattcagcgtcagcatcggcttcctcagcagctttttcctgggcttcttcgtacaaggccttaccgtcgacgtcgaagtgaccgttttccttgatgaagtcgaataaagagtccaaggatcttgaaccttggtacacaacagattcggacttcttaccacctgggtataagacgattgttgggtaaccttcaattacgacgcctctgacatcgttttcagtgtggtctagtttagcaatcaaaacgtcggatgtggcgttggcgtaggtatcagctagttcttggtaagttggggccaatctcttacagtgaccacaccatggggcatagtacaaaacaagaacgtccttctttgggtcgttgacgatttcgtcatggttcttaccgaccaattggaagacagaggaatcttggttctcgaagatctcttgggacttcacgattggggaggcatcacctttcaagaagtccttaaccaaagattcaatagccttagactccaacacgatcttgtcgctcaattcgtcaaacgcctcttcagagagttgaggcaaaccgtacttcaagtcttcagtcatgtcgtggatggcaaatagagggaattgttccttcatgttcaagttgccggcgtgtctgccgaattttctggcatcgatgctaacaaagttcattagacctctgttctttttggccaactcggtaaagagaggcttgtattcttccaattcttcctcgtcattgtagaataagtaacccaaaggcaaaccgctttcgacgtattgggcgaaaacggaaccgtcgatttcaccaaagtagggcaaggcttccacttgcaaccatttttcaaaaacatcagcgtcagcgatatcggctttcttaccgttgtatactacaggctcgtccatggcggagggcaagtaaatagaaagcttgaaatcatcgtctgcgttttcagcggagacaaagtcgtagtcgttgaagtgtttgttggccatggagtaaaaggtggcgttgaagtcggcgtcaatcttaccggattggacgataactggagtgacaaaagtctcgttagcaaggtaagctggtagatcagcaacaacggcgacagccggttggctttgcttgatcatgaattggacaatggcctcggcagttctaggtccctcgtaatcgatcgagttgttaacatcgctgtttttgaaaatcttcaagcttgggaaccctggaatgttgtgttccatacacagatcctggttttcagtacagtcgatctgggccaaggtaatgtttttctcaactaaagtctcggcggctttaacgtattcaggagccatgttcttacagtggccacaccatggagcaaaaaactccgcaagcaccaagtcgtgcgactgaatgtactcattgaaggagtcggtggccaacttaacgacagcggagtcttcaggggccacagcctcttgttgggcgaaaacagaggaggcgagcagcagggaggaccatgacaggacggcaccagcagaaaacttcataacgggatagatgtatgtttttctttatgtagagcttggcagctttaaaattaccaattagacatgctgcttgcaacaagaaaatgcacgcgtaacaaaatatatatatatatatatatatatatgtatgtccatacgggtttttcgttttgttgtggttgtaacagcacaacaaaatgctacacggtggcaaattggaaaaagagactagtgagagaaaagggaaaaagaggcgccgcccgacagggtaacatattatcacgtgcagcccaggataattttcaggacacgtgtttcgaaaggtttgtcgctccgaaaaaatcaaaaaaaacaaaaaacgggaaataacaataacgacaaaaatggaaaaaaaaaaaattttagacgcggcgcttgcaccccgcattataagtggtgtgccgacggacggtcaaccctttcagggggccccctatcttgcgtggtgtcacaccacgctcaaacggtgggcactaatgaaaaggggcccatataaatatccgctatcaacagaacccccaacccccccatcagtgcccaactcagcttccgtaaaccacaacaccaccactaatacaactctatcatacacaagatgtcattcgacgacttacacaaagccactgagagagcggtcatccaggccgtggaccagatctgcgacgatttcgaggttacccccgagaagctggacgaattaactgcttacttcatcgaacaaatggaaaaaggtctagctccaccaaaggaaggccacacattggcctcggacaaaggtcttcctatgattccggcgttcgtcaccgggtcacccaacgggacggagcgcggtgttttactagccgccgacctgggtggtaccaatttccgtatatgttctgttaacttgcatggagatcatactttctccatggagcaaatgaagtccaagattcccgatgatttgctagacgatgagaacgtcacatctgacgacctgtttgggtttctagcacgtcgtacactggcctttatgaagaagtatcacccggacgagttggccaagggtaaagacgccaagcccatgaaactggggttcactttctcataccctgtagaccagacctctctaaactccgggacattgatccgttggaccaagggtttccgcatcgcggacaccgtcggaaaggatgtcgtgcaattgtaccaggagcaattaagcgctcagggtatgcctatgatcaaggttgttgcattaaccaacgacaccgtcggaacgtacctatcgcattgctacacgtccgataacacggactcaatgacgtccggagaaatctcggagccggtcatcggatgtattttcggtaccggtaccaatgggtgctatatggaggagatcaacaagatcacgaagttgccacaggagttgcgtgacaagttgataaaggagggtaagacacacatgatcatcaatgtcgaatgggggtccttcgataatgagctcaagcacttgcctactactaagtatgacgtcgtaattgaccagaaactgtcaacgaacccgggatttcacttgtttgaaaaacgtgtctcagggatgttcttgggtgaggtgttgcgtaacattttagtggacttgcactcgcaaggcttgcttttgcaacagtacaggtccaaggaacaacttcctcgccacttgactacacctttccagttgtcatccgaagtgctgtcgcatattgaaattgacgactcgacaggtctacgtgaaacagagttgtcattattacagagtctcagactgcccaccactccaacagagcgtgttcaaattcaaaaattggtgcgcgcgatttctaggagatctgcgtatttagccgccgtgccgcttgccgcgatattgatcaagacaaatgctttgaacaagagatatcatggtgaagtcgagatcggttgtgatggttccgttgtggaatactaccccggtttcagatctatgctgagacacgccttagccttgtcacccttgggtgccgagggtgagaggaaggtgcacttgaagattgccaaggatggttccggagtgggtgccgccttgtgtgcgcttgtagcatgatctttttacatttttttggtttgtgtacgtatcccaccgtacttaccatcttctctcctttatatatatatatatatatgtatattttcagtgtatatacatacattcttatacaataccgtataagaacgtatgtatgtatgtatgattttctcacattaatgaacaatatcatcggaaacgggcctttggtttttaagggaaaatgaagaacaataaatgtcttgctaggtcttcctttatcattttccaactcaaatatgaaaagcagctccaaggggcgtactacttcaactaataaaatgtcacacactaataagatcgcatacgtgttgaacaatgacacggaggaaacagcctcgccctcttccgttggttgttttgacaagaaacagctcactaaattactgatacatactctaaaggagctgggctacgactccgccgctaaccagttactgctagagagcggcggatatcaaaatgagtctaaccacatccagactttcttcaaactcatcaagaccggccaattccatcttattaattggcagattgtttgctcgctgccccttgcccatagctctccgctaaggtccgaatggcttcaaaggctgctcattcccacgccgacgcccgccacgacttcacttttcgaccacatgctcctgcaactgcaatacctgcaacagctgatgagctctgtaaattcatctacttgttcggacgcagagatcgccacgctcagaaattacgtagagatcatgattctagttaatagacaaatattcctcgaattcttccatccagtcacaaattccgcctctcacaagggccctcacactgcactgcccgtcctgtatttgcgcaaaatcctcaaaaacttcatcgagatatgggattccctgctggtgtctaacgatcagttcctaaatgaagaaaacatcttcaatccggaaacgaccttgagagaactgtcgacgtacctgaccaacccaaaactaaccgcgcagttgaacctcgagcgagaccatctgattgacgccatctccaaatatatcgatccgaacgaactcgttcccaagggtcgtctcttgcatctcttgaaacaggccatcaagtatcaacaatcacaagacatttttaatatcatcgatccggatgatgacgcctctttctcctctccaccccaccggatcaaccttttgcaggataacttctcacacgatctgactgtgacctttcaagaatggaagactatccaagacaccacagacgaaatttggtttttgacattttcgcccaatggcaagtatttggcttctgcgacttccgagtcttcaagaggctacttcattactgtttatgatgtggaacaagacttcaaaatttataagacttgcgtgagcttgtcacaatccgtattgtacctcatgttttctcctgatagccggtatctggttgcttgccctttcagcgaagatgttaccatttacgacatgaatgccacctccctgcccgatgcgtctgccacagactcgttcctactatacccttctaccaggctctcgcccatggactcgtttaaactggacaccaccacgtacccagatgataccgaatcatcagcatcatcttcctcgaggccggcaaacgcgaattctaatcaatcaagagtatggtgctgcgatgccttccacactgcggaacgtgcgggctggatggtggttggatcgcccgacagagaagctattgtacactcactcaccacgaaagagtcactttttagcttaaaaggcaggacttgtatcgcgttgggccacgatgaaaacatctctgggagaaaatcaatcgatcctgcaaaagtcctttacaaaccaacaagtagcaatggtaactggcaatatgtggaggacgacgaaacctttccacgtgtgcacgacgtgaaaatcagctatgacgataaatacgtgcttttaatgacccaccagggcgttatagatgtctacgatttcagtgggttcccctccaaagaggagctatctaagcaaacagtggatcccaaaaactttctgattccaaggatcgcaagattggacgtgggcaaaaacatgacttgtatctcattaccgctaaataccacgcatcaaggcttccataggcaacaaatatccgagtctcaacatttggtattagttagccttcaagataacgaattacaaatgtgggactataaagaaaatattctcatacaaaagtactttggacagaagcaacagcactttattatcagatcttgcttcgcctacggtaataagcttgtcatgagcggatcagaagatggtaaaatttacatttgggatagaattagaggtaacctagtatctgttttatccggtcattccacggtaatgagtaattccacaaaacccatggggaaaaattgtaacgtagttgcatcaaaccctgcagataaagaaatgtttgcttctggcggtgatgacggtaagataaaaatctggaaaatttcaagaaattaatactccaccttatatatatacgtaagcaaagttttatgtaacaaaaaaaaaaaaagaactaatccaaccttctttcactttcaggtaaaacttgactgagttcttcagcctctcttctacctctcttgacatccaaacagtttagcacaggcaatgatagcatcaaaagcaaaaagaagaaataaaacgaatagcgaatattatgcgttttatcggtaagcagtccaacaaggaagggtcccaggatggacgaccccttatctgtgatactgaacatactaaaaaacgtggattcttttcctggaggtacaatcaaactgaaaactgatcttgaaaccgcggacaggccacctagtgataatccataccaaatggccaataagaacatttcaaacttatgctttaaaccgaacgcattgaagaaaaatccaagaataccataaaatggtatgaaacttgcccaaatgataatgtacatcaaagtttgactagaagtccaccgaaactttgtggcaagaaattgtggaatcataaaggcacccagcattgcatttacaacggtcaaaacacttatcatgattaaattgagggtactcatgtgcagttctgccttggagaacaaaaccgctgtagaatttatagttgtaatggaatcactaataataaaccacgcaataagaaaaatcatcacatctttcaatagtctggcatgtttaaacgattcgaaaagcgaaacccaaccatatgaaaggtaattcttccagtttagttgacccaaggcgtcttgctcaccgggatacggactgcgggcggatgctaatgtagaatcgtcaactcttatcggtattgtcacatcgtcaatcaaccagatcatgggcagttgccacacaaaccaccaaatcccaacgaaaagaacagccacttgaacatcctgcttactgccctttttagatgcgactaagaacatagatacaatctgaacaatgagggcacttgaataacctaaagatgcacctctaccgctaataacagtagttaacgagtctaccttatcaggttcataagctccttgactttgacatttcaaagaatccttgacaaaaatgggcagaagagaattcccaacaacattgataacgccaaaacaaccattggccactatataaagcccagccagagaataaatctgggtatcattcaattttgaaatcgcaacagtcgacaatgcgcccacaataccaaaccaaaccagaattctgcctttgaatttaacgctcccccagagatctactatccctgaaacggaaatgactattatagtttggaataaaacgctaagggaaaagacatataatgcaaaacttgaagtatctacgaagatccgattgttgaacaaaccaagaacacacttatctgaatcactacccgtttctgacaggcagggtatggagtgatcgtgaacttttacaccatttatactcgcaaattgctgcagtagtaagggaatatacgttgaaaccgcagaaacgacaaatggttcgctagaaaatgagtaagcgtaccatcccttgatattgttttgggctttttttattcgatagttcgttaccgattcattcatatcatttatagttccatagctcatatctaatgtagagaatatgttatgagcaaactattgcttataagggcaaaaaccgtggtaatataggtacagtttgaaatctttccttttgtttacactacgcatctttcatagctgaggtattttcgtttaggaaaataccgttttaaggaattaattttagcaatttcctaaaattgttgagcggcgctatcaatgccgcacaatacaacaattaataatctaagacacgttgcattatacatgacagaagctaaagcatggtcttagatgacaataaaaaggaatttgacagcacaaaagagaaaaaaaaaactatacataaaattttttacatatgaattgcttagagtaaaataggcatttttcatatcttcttcccaattattaaattagcaaaaaattgaataaaaaaagcaggtggtttaagaattgcgcagggagaagaaagaatatcatatctcatgatggtagccacttagacagagagaaaacgaagtgagaagaggctagtatttttatatcttaaaaaaaaaaaaaaaacaaaaaaaaaaaaacataaatatttgtatcttattgcttatgatgataatgtacaatgaattcaaaacatgaaaattgttcaaagtttttatttttattttctctttcgtattaaactgatggaacaaatgaaaaaaatggataaaaaaacaaaaaaaaaaaaaaaacaaaaaaaaaacagctttgctggaggatgattaacttttaatttttttaattattaggtttttcaattttttatggttttttgtgtaaaatgcaatgaacgaatccattttttattttgcaagtgtgagaggcctttataaggaagactcggattcaccggcagcaaccggcgcagagtcttctttggtttcttgttcttgagaagcgagttcagtggatgattcctcttcttgttgaggaacaggtggtagggatatcatgaattggtccaatgcatcgccgaccagttctttttcaatattaatttcagtttcaaaagtttctggtaaccagtttgaccagctcttggaacgaacgaagtacttatccaatggagatggttctttggcttcaccggtaacgttatcaccttccttggcggccaaagtaccttctgcaacattgacggtagcggcttcgttagcgacaatttctctcaatgcggctaaaatcaggttagtgtcacctccgaaggacatgttaacaactctgtaaaacttagagattaaagacaatggagcaaaaccatccttggagagtttggaccttaagtaattgtcgacggtcaagttttcttcgctgaaatagtattcaatttgtctagcaatgttgttgatggccattaacactggttggactggataaaactgttgctgtaatttgaccataggttgttgaggatgttgttggttgtgatggaagtggttgtggtatttagagcggttgttgttgttattacgagcgttgcgtccttggtaaggtttaaactgtggtgggaagccttggttctgaggcataccggcgttattactgttgtggaactttctcctttgaggaccattgctgttatggtgatgactgtggtgatgattacggtggtgaggtggttgttgctgttgtgtagattgaccattttcttgagaggtagcgtcttttgaatcttcctcacctactgccgattcaaagccatctttcttcatttgttgttgcttcttagcattatgttggtgatgcttctttttcctgttagcattactcgacgatgtcgacgatgctgcagttttgttgtttttgctcttgttgctgttgccattacttgcaccattcttggaaccggatcttttggtgccagagacggtaatggaggccttgatgggaacccacttggtagcagtcgatgatttcggagtgggtgttctgttcttcttctttcttgtggcatccaagtcttctattgagatagtagaaacagggatctcagtaggagcaagtttccatggggaagatgtgggcaatggtgccggcgtcaagttgacttgcttgctcttggagctctcttgttcttgcacttctgggactggggcagtagcagtgtttgcggcggcggtttcagcagacatcgtgggcagagaagtgaaaagaagatgaaacacgttagcaggtccagagtaatcctgatgttctattaccgatctaggatcccaaaagatcttcataaaaccgaaaaagatgttaagaaatgtttacacttgtacttttctttctttgttcttgacctaccagaagtgaaaaaaatttttcattgcgtgggtacatccgtgcaccatttctgaaaaatttgcgatgagcatccctcaaaatccgtattatccgctagtgttttgaggttcaacaagacaacatataagaagggaagaaggaaaggaggcaatgagaacttgggtcttgctcgagagtccagatccacatgcaggttcaaaaaatggtgagagataacagtaataacggtagcgataaaagcgtccattgggagaggaggaataataacggcgcaggcccccgttatcgttccagaagcggtaataccggtgctttggcaacaaaactaagtaatgggacgctctctgtcagaggattagtgaaggaccgaacaggaagcggcaagatcgcgggctgtgtggaggcgtttctggatgccaggacccaattgaatacgccctgggaccgtgctaagtgcaattggctggaccagatagattactatgtacagttgagaaagaccgcgttttctaaggaattggaccaactaaggaagcccatgatcgatgcatatgtggcggagatgaggcagaagtttgatgcctcctatggacaatccagggcgcaattggaagccaaactggcgcaggtggacagtgaatggcatatggtacatggtgatgtgcatgcaaaactggaaaaactcgtggaagaacgccggtttttgaaaagattaagcgacacgatcgtaccacccaggtccaaaagatcacagcggctgtctccattgaccaaagaggaccgagccaactgtatctgtccgcagcccaaaggaatgagcgacaccgcttggttcgaagccattcagaagaaaatgttaggaatgaatggtaccatcaagctcctagagacagaacagaaactactggctgacgagaaaaacagcgtgaggaagacgttctggcccatggtggaagcacattcacgctcgaatgaatttgcttatctggagaaatgcatcaggctgatggcctctcagagagcaatatgcttttgtcttgatatagaggctttcgaaacaaaccagaacgtaatcaccgaaattgggatttcaatttatgaccccagggaaaatatggtgccgtcaatggttccaattacaaagaattaccacctaattatcgaggagtccctggaacttagaaaccaaaaatgggtctgtgactacaaggattgctacttattgggagaaagctatgttttgagcttgaaagagtgcgtgcatttcattcaatcactaataaactattacttggtcccggtgaccgaagaagacaagacatggtcaagggcatttgttggtcatcacgtgagcggggatcttaagtggctggagactattggtgtcaaattccctggcagagggtatgaaggccatctggaccatacgctgcttttggctgaaactcccggtgatctagacgtgttcatcttggacactgagcagttttacaggaaatcgtatggcgaaaagggcagcagtctgggcaagattctgcggttgttcgagataccgcatgcgtttctacacaatgccggtaacgatgcctactataccctgcatttgttcatgaagttttgcgatgttaatttcaggaaaataagcggcatggacgatgttcttaaagtaatgggccaagtaaaagtttggggagaacgagacgtacgagagcctaaagtggtgcccatgtcgtatgccatctccatcgaggaggcagtcaaaaatcggacgtaccgcaagggcgtcaagagcagtaggaaggaaagagtctgccaaacggaattcggtgggttaacgtatttcggaactgctaaagacgccttcacaagcactcttccgacacactaaatatattcatcgatttttttcctgtaaatacaaacacatgcttgtatacatatacatatacatatatataagctcattataaacctgtgtgcatggaaaaaactttgtctgcccttaatttgcaagaataggttctaacaattcctccaattcaccagtctccctcaattcctgcaagtcgtcgttgcctccaatatgtttaccattaatatagatgtttggcacggttctttggccattaatctcatataacgcagcctgaatgtctgcgccttccttcatgtcattcaattgcaaaaccagaactttggacctgggaacctttaacttttcaaaaagcgtgtttagggctgcatggcagtatggacagtacgttttggatgcgacgaagatctcgttttctgcaataaggtccttgacgtgcttgatagtttcttgagataccattttttttccttctgaggttttgtctatttgtataattatgcgaatgctcgtataagtactgcacgaagttctttattttatgctaaagtccctttttatattatataaacttttcatttattttatatatttactcctttcaagacaaaattcccacatcacgtgaatcaggaggcgcaaggggggtagtaaggcagtagtagataaagaaaacaagcatcgcaatctggaaacgccgttgcggctgctcgttatctgtagacagctcacttgtgcatgaagttcatgttttatagatgatggagccatacttcaaggtgataactatgaaactgttttgaccttgacgtgtaaagtgatcaaggtaatagttaaactttatatatgttgtttatcaatgtggtatcctttctaaggatgaagacaacacgattgtgacagtgtgagagagtgataaagcattggaggcaggcaaaacaagaacatggggtttctttcggatcatccgcatacagctatcaccgagacgatctttcgaattgtctcttcaagggactatacgctagaagtggagttagctcccttgattcagcttatcaaagcagatcacaacgattataactataccgtgaaccaagaagaactgcgcgagcacttagaaagaaaataaagtatgggaaccggctgcagcagtccaggactctggacctcttggatctgttcatctcacaaggcgtgaagtttacagtcatgtacaatgatgacaagctgctgcaaaggctgagagggatggctacgaactctgaaaacagcgggtccggtgaaaagtatgagcctaggattattaagaagtgcgcggcgtatgctatctcgtggctaaactatattacgcagaacaaccttgagaatgcgagggcgtattcaggtctttatcaattgggtcaaacagtcaaacagaggtactcgaagagcagccgttcccgccgtagcgcgaggctctggcggacggtctaacttcatggatgatagcgccgacgacactttgtaccagtccaactcgctgactagtgccgatagattgtataggattccacagatcaacatgaacaaagaggcacccaggattcggctcataatcagcgatgctctcgcgtctgctgtgtcgttacagaactcgctgatcgggctgcccaagggcaagttctccacagacgatgaagaggccacgtccaagttcatccaggcaagggcgatcagaaggaaagttcttagatatctgcaattggtcacggagggtgagtttctgggtagcttaattcatgccaatgatgaactggtggctgcgttgactgcatacgacgaccgaagcgctcaggacgatagcagcgatgaaagtgatcacggctcgtacgatgacggtatttatgatgaaaacgagcaggataacagcaggtatattgatagcgagtcctcagaggaagagagcttgtcttcttatcagccgtccacgatctcaaaccctttcggtgatcataacaaaatttgaagaagtatgtacgtatgcatacacacatatatatatatatatatatagtacatttaatccttcttgaggtttaaagacgcactgttcacacagtgtctggtgtccttgggcaagtttagcaactgtttccagccttcaccttcaaacacatgtcccaagtgtccaccacaccttgcacaacatatctccaccctcgcaggcattaaagaattgtcacgatgatatgtgatggctccaggggatacctcttcgtagaatgcgggccatccacaacgagcgtcgaacttggccttgctcgaatacaacggtctgtcgcagttggcacaatggtagacaccggactcgttggtgtgtaaatacgcaccggtgttgggcctttcagtggccttatctctcagcaccatcagctgcaatggtgtcagggcatcgttccacttcacgtcattcgattcgtcactcattttcttgctcttattccagtactgcgtcagtacaatgtttcttctccctggaaaagtcctgcgtacagttataacgtacagcctgctccacttattcattttttgatattgcttcctttctccctttatttaaactatcatcggcgacatatttcccaataggcaaagctgaaaaatactatcgctaattataacaaagaagctaggtcgaaggactcgaaaagacagaggtcgtactagcagagatagcaaatcagatggaggacggtaaacaggccatcaatgagggatcaaacgatgcttcgccggatctggacgtgaatggcacaatattgatgaataatgaagacttttcccagtggtcggttgatgatgtgataacttggtgtatatccacgctggaggtggaagaaaccgatccattatgtcagagactgcgagaaaatgatattgtaggagatcttttgccggaattgtgcttgcaagattgccaggacttgtgtgacggtgatttgaataaggccataaaattcaagatactgatcaataagatgagagacagcaagttggagtggaaggacgacaagactcaagaggacatgataacggtactgaaaaacttgtacactactacatctgcgaaattgcaagaatttcaatcgcagtacacaaggctgaggatggatgtcttggacgtaatgaagaccagctcaagctcttctccgattaacacacatggagtgtccactacggtaccttcttcaaacaacacaattatacccagtagtgacggtgtgtctctttcacaaacagactatttcgacacagttcataaccgacaatcaccgtcaaggagagaatccccggtaacggtatttaggcaacccagtctttcccactcaaaatctttgcacaaggatagcaaaaacaaagtaccccaaatatctacaaaccaatctcacccatctgccgtttcaacagcgaacacaccggggccatcacctaacgaggcgttaaaacagttgcgtgcatctaaagaagactcctgcgaacggatcttgaaaaacgcaatgaaaagacataacttagcagatcaggattggagacaatatgtcttggtcatttgctatggggatcaagagaggctgttagaattgaacgaaaagcctgtgatcatattcaagaacttaaagcaacagggtttgcaccccgccattatgttaagaagaagaggtgatttcgaagaagtagcaatgatgaacggaagtgacaatgtcacccccggtggaagactctaatgtgcagttgtcatgcacatcatcatactaaacttacacgaataggataacatgtatgctagcagaatatatatgaaagaaaaaaattattgatgcctttaaacttatactattatactatattatgttatattatattattagttttatagatatattgagatatgttgaatatgatgacgaggatggtggtttaagtgtatggattgaattttctcttagctttcattaccttgattctttcttgatcttccttaaatttacttaacagttgattgatctcctgttttttacgttctctgacctgaaatctatagaaatctttctttgcctttttatctatatttgaaattggcttggccttattttcatgtttggataatggatttttgtttaatattttctttcttatggaattcaatgacttggtgttctttcctacaactaatgtgaatccatcctcatccactatagaactttgaacatcctcttgtgcttgagcttcacgctgttcaaaaattgccatatgtgtatgaatatcttctttcaaataatcaatatccagtggtttgtagaagttaacaaaagttgtgaatgatggagtcgtatatgtccattcaaatagttcatttggatgtttggcatgcaaattcgagtattttttcaaagcattccagcagttatttatacttgcagcatcaacaaattttaatagcgccgtgtttcttggtgtgtatctcttctcgttgacgtcagtggaggacatcagatcggaggtcaatgccgataaatctacttcatgtaatccaaattcatcgttatatagtagttcctctacatgcgatactgtatcgtatttcccacagagctgcccgacaaatttcttcatgtgctctatgttagataataatggaaggttgaccaaaaacaaacagtcagactcgttggaatttgaactctggtgtcttttagcaaacatgaaatgcaacgaagcttcctggcttttgggtagtgccttgtgatccggtaatttgaacggcaccactataaacccgttcttcatggcgctaatgtcttcaatacccatcccgtaacactctatctgaggttgttatctgttacctagttcgttcgccctaaatgcctcttgctttaccatcctctcaatgttctcttctttttcctgcttatttcttaggtgaccaaaaagtgaaaaattttccaatttaacttacgtcgttcgaagtgatgacaataaggatattcatttattaatcgctatttgatacccactcttgctactacctctcttttaatccaaaattacaatttttacgttaccattcattacatagtgtatctctattcattcaagactgtattttgtttgatatatatatgtatatatacatattattttcgttagtgttcggtttccaagttagaaataatctactggaaatcctttgggatcaacccaagcttactcattctgattttcacagcgtttctgtgaccgtctagaccctccttcttggcaacgcacataacagctctaccgatgttttctaaaccttcaggggtaatgttttgggcagtgataaacttttggaaggttgcagtgttggcaccactgtactgcctagcgtaaccataggttggtaatgtatggttagtaccacttgaatagtcaccgcacgattctggagtgtaagcacccacaaatacggaccctgcattgtcaaccaatttaacataatcgttagcattggcgatttgtagaatcaaatgttctggtgcatattggttggacatttcaagggcttcttcgtaaccgtcacaaagaacgatcgtactgtgagcaatacatttacgaacaatatccacacgtggcagttgtaaagcttgattgtggacagcatcttgaatctcttgaattttcttttcgctcaagttaacaccaacaaggataacttgggagtcaataccgtgttcagcttgcgatagcaaatcacttgcaacaaaatccacatcggcatcttcatcggcaataaccaaaacttcacttgggccagctggcatatcaatggaacatagagcttgagtgtcattttgaacatacattttggcggcagtcacaaattgattacctggacccaagatcttatccactttaggaatagtttctgtcccgtaagccatagcagcaacggcttgggcaccaccagctagaacaatcttggaagcgccaactttttctgcgacataaacaacttcgggtgaaactttaccatcagattttcttggtggagatgcaaacacaatctccttacattgggcaacttgtgctggaacaccaagcattaatgcagtacttggtaaaatggcagtgccaccagggatatacaaaccaactttttcaataggacgagggaatctggaacacaagacaccaggttgggtttcaacttcaagagtctctgttggcaattgagcagcatggaatttgcggacgttttcaattgaaaggtccaaagcttccttcatttcctcggttaaaccttcaaagtattcttctgggaatggagcattaagaacaggattggataattttacaccatcaaacttttctgtgtactccaaaagggcagagttacctttgtctctaacattttcgatgatcggattgactaaatgcataatttcagaagtcttttggattggtctcctcaaagccttctgcacaccaactttgtcggaagccttcaccacgtccaagtgaattggaccggtcagtttttcttcttcagcctttggttgtccaacaaactttggcttagcatcacctttccgtcttgtaaccttcagatgcttcatattcagattattctcgacgtccttcaatgaaacatcgttggccactaatttggccagtgcaaagtagaacaaatcggcagcctcccaagaaagctccttcttaccctttgcctcagtcagttcttcagcttcttccttgatcttggcatctaacaatgcagagtcgttgaatagtcttctagtataagattcctctggagcgtcctgtagcctttgttttagtaaagattctagccccaccaaaccatgcttgaattcaccaaagcaagacatggtctccaagtggcaaaatccaacgttttcttgttcaacgataaactttaaggcatccgaatcacagtcagtagagatttgtaaaagcttttggccattgccagaagtttcacccttgatccagatttcattcctagaacgagaataataaacgccacgacccaaatcgatggcctttgctatagatttcttcgaagaatacaccaaccctagacaacgctcatattggtcgacaactagggtggtatataaaccgtcaggacggtctgtacgtacttcaccaagcacttctttggtcaacatatccttgcttaatttctttatggacacaattttatcttgcgagaatttttgttttaccatgaattgattggagaaaacaccgttctcttccacaacaacacgctcctttggtacattcaattgttcaaccaagtgttcggctgttttagcatcttggctagcaatgaacagagaagaaactccgttgttcaagaaggcaatgatttcatcatcgctgaatttaccacttggcaaggacaaagccaccaatggaacttcttcctctttggagaactggagaatctcttcattactcaggctcgagccatccaaaagtacctgaccaacaagtgaaacgtattccttcttactattccatgaggccagatcatcaattaacggtagaatcggcaaaaccattattcagaaaaaaaattttgtaaactattgtattactattacacagcgcagttgtgctatgatatttttatgtatgtacaacacacatcggaggtgaatataacgttccatatctattatatacacagtatactactgttcatagtcatatccttttcttaccttctatatcgaatgactgataaaaaaacgtgagtcactgtgcatgggtttagcaattaattaactaatttaccggagtcactattagagtcagttcgactgcctagaagaactgctggttgtcaggattgtgatgggggcattctgctgtattatgacccatcgtatcgcaatgctcacaccactgttgtcttcctgccgtggtatcgactggtgcaggggggtcgaaaattggcaacgattccacggctgtttgtgcttgagcctgttccaactgtttgattttttcattagcctcttcaagttttttcgttaaggatgccacctcttccgatgaggaatcttgtggttttgtcaaaaatagttccttgctcaaattttggtattctttactgagcgaatcgttatgcattttcaattgttcgcgttctttagcccactttgtcttgtgtaactcaaattggtcttctatgttgcgtaattgttccagctgttttttcaggagttcgacatcttcgttggcaccagtgggttgattatgagaaagatttctctcttcgttttctttgatctcttcgtgtagttggcttacgacagcaagtagctgttcattctcagcgtcaaaaaactgcttttgtttggcttgctgtctgcgttcgagctccaattgttgcttgagatggtctatctctttctctctttcttgtattgtggcttcatacctatcaaaagtcggttgcacttcttcgaggaccattctttggtcatcgagtagccttttgtagtgtagttgtttcctttgtagcttttcgatggtcaattgggcttctcgtaattcaattgtaacttcgctgctattgaggtcattcatgtggccattgtccggtttccaatcgctggtggtgttgtgattagcctttctgtctgatgacaggatagagtcgacctccattctgtcttctctgttatcgtaaccaaattcttgctgttgatggtgatccgatgcctcctggtccatcgactgttgattaccgctgtgccgactggtgatccggaaacttctcatgggtgtgggggatttaggatcatccatgggagagaactggttagtgagcctcacaatagatctgtttttgggtattgatagcggttccatcgtcgttcttctcgaggtttgcgatatcgatgccttctcgatcaatgatgcgactttttgcaactggataaatagtccactttgaggatactctgtttgaaaatacttcttccccatgaatgatccatcgttcttaccaatgttggcaagtaagtctacaccagcaaacattccagctttcgtgtccactggacccacgtatttcagttgtccgcgccccaaatttgggatttgtatgaaacatcctatctttctttgatatctatccatggtatttcaaacgcatacacagccagccacagctcaacgccttttaccttgtcctttgatgcctgtctcgtccaaacgtttttggtgtcttggccaattgcccttctgaaaaatctcactgtccgcaactcattaaaagatacccaagcaagctacacgataaagaaaggagaaagttcattaaaagaacgtacatatagcgatacaaacgtatagcaaagatctgaaatggatacggataagttaatctcagaggctgagtctcatttttctcaaggaaaccatgcagaagctgttgcgaagttgacatccgcagctcagtcgaaccccaatgacgagcaaatgtcaactattgaatcattaattcaaaaaatcgcaggatacgtcatggacaaccgtagtggtggtagtgacgcctcgcaagatcgtgctgctggtggtggttcatcttttatgaacactttaatggcagactctaagggttcttcccaaacgcaactaggaaaactagctttgttagccacagtgatgacacactcatcaaataaaggttcttctaacagagggtttgacgtagggactgtcatgtcaatgctaagtggttctggcggcgggagccaaagtatgggtgcttccggcctggctgccttggcttctcaattctttaagtcaggtaacaattcccaaggtcagggacaaggtcaaggtcaaggtcaaggtcaaggacaaggtcaaggtcaaggttcttttactgctttggcgtctttggcttcatctttcatgaattccaacaacaataatcagcaaggtcaaaatcaaagctccggtggttcctcctttggagcactagcttctatggcaagttcttttatgcattccaataataatcagaactccaacaatagtcaacagggttataaccaatcctatcaaaacggtaaccaaaatagtcaaggttacaataatcaacagtaccaaggtggcaacggtggttaccaacaacaacagggacaatctggtggtgctttttcctcattggcctccatggctcaatcttacttaggtggtggacaaactcaatccaaccaacagcaatacaatcaacaaggccaaaacaaccagcagcaataccagcaacaaggccaaaactatcagcaccaacaacagggtcagcagcagcaacaaggccactccagttcattctcagctttggcttccatggcaagttcctacctgggcaataactccaattcaaattcgagttatgggggccagcaacaggctaatgagtatggtagaccacaacacaatggtcaacaacaatctaatgagtacggaagaccgcaatacggcggaaaccagaactccaatggacagcacgaatcctttaatttttctggcaacttttctcaacagaacaataacggcaaccagaaccgctactgaacgatgattcagttcgccttctatccctttgtttacgtatttgtttatatatataactttattttttttattaattgggctgcaagacaattttgttgtcagtgatgcctcaatccttcttttgcttccatatttaccatgtggaccctttcaaaacagagttgtatctctgcaggatgccctttttgacgtattgaatggcataattgcactgtcacttttcgcgctgtctcattttggtgcgatgatgaaacaaacatgaaacgtcagtaatttgaaacaaataacgtaattctcgggattggttttatttaaatgacaatgtaagagtggctttgtaaggtatgtgttgctcttaaaatatttggatacgacatcctttatctttttcctttaagagcaggatataagccatcaagtttctgaaaatcaaaatggtagcaacaataatgcagacgacaacaactgtgctgacgacagtcgccgcaatgtctactaccttagcatcaaattacatatcttcgcaagctagttcctcgacgagtgtaacaacagtaacgacaatagcgacatcaatacgctctacaccgtctaatctactcttttctaatgtggcggctcagccaaaatcatcttcagcaagcacaattgggctttcaatcggacttcccatcggaatattctgtttcggattacttatccttttgtgttatttctaccttaaaaggaattcggtgtccatttcaaatccacccatgtcagctacgattccaagggaagaggaatattgtcgccgcactaattggttctcacggttatttcggcagagtaagtgtgaggatcagaattcatattctaatcgtgatattgagaagtataacgacacccagtggacctcgggtgataacatgtcttcaaaaatacagtacaaaatttccaaacccataataccgcagcatatactgacacctaagaaaacggtgaagaacccatatgcttggtctggtaaaaacatttcgttagaccccaaagtgaacgaaatggaggaagagaaagttgtggatgcattcctgtatactaaaccaccgaatattgtccatattgaatccagcatgccctcgtataatgatttaccttctcaaaaaacggtgtcctcaaagaaaactgcgttaaaaacgagtgagaaatggagttacgaatctccactatctcgatggttcttgaggggttctacatactttaaggattatggcttatcaaagacctctttaaagaccccaactggggctccacaactgaagcaaatgaaaatgctctcccggataagtaagggttacttcaatgagtcagatataatgcctgacgaacgatcgcccatcttggagtataataacacgcctctggatgcaaatgacagcgtgaataacttgggtaataccacgccagattcacaaatcacatcttatcgcaacaataacatcgatctaatcacggcaagaccccattcagtgatatacggtactactgcacaacaaactttggaaaccaacttcaatgatcatcatgactgcaataaaagcactgagaaacacgagttgataatacccaccccatcaaaaccactaaagaaaaggaaaaaaagaagacaaagtaaaatgtatcagcatttacaacatttgtcacgttctaaaccattgccgcttactccaaactccaaatataatggagaggctagcgtccaattagggaagacatatacagttattcaggattacgagcctagattgacagacgaaataagaatctcgctgggtgaaaaagttaaaattctggccactcataccgatggatggtgtctggtagagaagtgtaatacacgaaagggtactattcacgtcagtgttgacgataaaagatacctcaatgaagatagaggcattgtgcctggtgactgtctccaagaatacgactgatgaaaataatattgacgttcgcatttaatctatacctataattctgtacttatatactgttccttaattgaagatttcaacatcgtttttgatgtaggtcttttcacctggaggtgcggctggggtaccgaagactaattgagcttgtacggtccaagactcagggattttgcttggcaaagcagcttttatgtaaccattgtagtgttgtaggtgaccacccaggcccattgcctccaaggcaacccacgagttgatttgagcggcaccagaggtatggtccgcgaaactagggaatgcagctgcgtacgctgggaagtcagcctttagcttttcagttaccttgtcgtcggtgaagaagattacagaaccaaaggcctcatcccttgctgaagcaggcctcttttgaccggcaggctttctatagccttagtcacttcgtcccaaacttttttgtgagtttcaccagtcaagataacagcgcgatttggctgggagttgaaagcggtgggtgtttctttaatgatggtttggacgacggattggatgtcgttgatagtaatttcaccaggtaactccggtttcaaagcgtaaatagtacgacgagcagttaaagttttcaaataagttgcaaccagcagacatgatattggattgtttctttgtatatatgttgatataggatacttcagtctacgaaaaaagtacaaattatgtagtcagttccttcagcatggtgtccttatatactgtagtttggacaaggtgcaaatgccaagaccctagcccgaaaagctcgaggcaccccaggatctttttctttacgtaattttcacgtaaaacgccacagtccgatttttttcgaataatcattagtaaaagcggtatactggattattgtacgataacaaggtagagctttattactaagctaagacgttcttacatcaatagtgctgttcgttattgatgttaggagaaggagagggtctgctgaatagtgtgagcagtgtttctgaactttttcttcgtctaagtccttgtaatgtaaggtaagaatgcaagcatcttgtttgtaacgcgattgtacgttgacgttagtaagtcacaaacccaagcttaacttcttcgtgaggaaggaaagtgttgtctcctactttttttaaattttcgaattgtatttatatttatttagtacttcttgagtttacatatccttcgtaaaaatgcaacttctgtcgaaaaacacttccaaaaaaaaataataatgaatttatgaagcatactaacgagcgagcacatcgctgaggtatcattacttcatgagataaattaagatctcctcatatgcgaatttcctgttcagtgataaacgttgattacgttattgataaaagtcttttcttctggcaaggcagttggaacaccaaagaccaattgagattgtacagtccacgcaataggaacatcttgaggcaaagcagatttgacgtagtcattatagtgttgcaaattagcccccaatcccaatagttcgagggcagtccaagactgaatttgcacagcaccggtcgtatgagcggcgcatgttgggaaagcggtgccaaggctggaaaatctcttgcagttttcagttggtccttcatcagtgaagaaaatgactgaaccgtaagcctcatctctgcaagactctggtctcttcttggcttcagcagttggcattgcgctcgcaacagcatcccatatccttttgtgtgtatcaccaacgataatgacagcgcgattcacttgtgagttaaaagctgttggcgtattcttgagaataacgtgtacagttctctttacatcatccaaaccgacaccttgtggtaattcgggcttcaaattgtagatggtacgacggtttgtaatagcgtttaagtagtttccagttggggacatttctttggcttggaggtctggtgttcttgattttgatggtgtatatagctttaaaaaaccaaaaatgatcaacctttatatctctcttcgatcacaacatgggtggagacaaacacaaagtagtgatgacccactcaggtgttaaagtgtgtcatatctgcaaatgacactgtatttttttttcctttgccatttattgtcgcagtaaggaaaagcgcagagcaaagctgacaaattgaaaaattattcggaagagcattaacaaatattgattaataatcaagtaacactcgcagacattgttatttcagaagtaaaaatatcgcagaacaagttggttaaactgaatgcttcagtcattctaatgctaattacaccttaacaaaattaaaaattcttaacgtagatttttaaaaaaggcaagaagatcgttcctgatgcacgacgaaaacggttgcacccctactaaggcaaaattgcatatgcggatgaaatcaaacctcttctgttgcattaagaacaaaaggaaatcatttttctctcacttcatattatttcacttatattttcctctccatttccatcacgcaatcgttagtgctttttattttttttcttcgctcataaaggactagaattaaaatgaaaatcgtctatcattacacgtatgctattactacaaaacagaagtacaaaaatgaataaatataaaagaagtaaatgctttttttttaacaccagaaggcaacgacccttttccaataaggtccgttcctcaaacgttccctatattcttcgtcttcttgcttgattaattcttcatcaaagatttgtctatgagaatctaggtcgatcttgtcggccctgatgaacagtttccaatccttgtgccagaccttgtagccgacatatagtgcaatcaagattggcatagccaagtagttttcgaaaaaggcttgtgcatccagcttaccttcaccaatgggggcgatagcgacccaaaattgggcaataagaattaaaatcatcataatgcaagcgtaggcagatccccaaacaccagtttgagatttgaaacccaattctccaagagatctcccttggactttcatggctcttctaaatctaagatgggataaacaaatggcagtccatgtgaaaagctgagacaaaccagaaatggccaataaccaagtgaaaacttgttcttccttgggagatgcagcacagaaggcaataacggcaaacaatgcagaaacacccatggcaatcaatggtctaccggctctgtcgatgtaggagaaaaccttaggagcgtaaccttgctcggatagagttaaaaataaacgagcactggagtagaaggaggagttagccatggacagcacggaaagtagaataacggcgttaatgaagtgtgggacgacacggacaccgtgggatgcaacagcaatgacatatggcgaggctttagtaccaccaccggtagaacccaataattgatcggaattgtatggcaccaagaaacccagtagaataatggtagccaagaataggaataagattctgtagatcatttgtttggccgcacctggaatggcctttcttggattagattgttctgcagtggtgatggcaataaactctgaaccaccaaaggcaaaagcagcagtcactaatgttgcaacaacacctttaaatctgtcaatggcatgtttaccattgaaagcgcccggatcgtgccagtatttaccaccaataaaaccatcattaccagcgccaccaacatcgatgataataccaagaatgaagaacccagtcatcatcaaaattttgcaacagttgaagaagaactcagcttctgcataaccacgagcaccgaaaatattaatagtaatcaccaaaacatagaaaataatgacgaacacatccgggttcacagatgtcgtccaatatttgatagtcatggatgcggtcaccaattccagaggacacacacacagccattgcaaacaataaacccaagcgactgcaaacccaaaaaccatcatccacaaggaaactgggtatgcattgtagccaccagtcaagttactatacactagcgccatttcaccacatgcttgaataatacagtacaagatagaacccataatagcgtaaccaataagtagtccagctggacccgcatgaaccaacgcggtaccgttaccgaccagtaacccagtaccgatacccgtacccaacgcaatcatcagaacatgtctaggctgaatggttttcttcagcgagtccgacttatgacctgtattagcgcctatgttgtccgaactttcatttttttctagttcttgagcctgtctagaagaaggtgagatagccgacgtaagatcgttcatttgtgttgcttctacttcatcctgtggaccctgatccgctcttttaaaggagtcgaaaaacctacgcacggcagaagtgttatgctgttcgtaacctaaatgaggttgtgaggatggacggtcattggagcctgtttcgaaatattcaatttcattatcctgccccgtggcatgtatttctgtggagctatttttcaagtctttcagttcgtatagagacttcgacgacgacattgtgcgaagctatctttgtctatattagcgtgcttcttctataaagattacataataaacttgttctacattgttgtgggcagaccatcaaagacaaagcacttatatatgtatgtaaaacaaatgagtattacgaggaaataacaaaagaaactaatcacgaaggatatgagtcttgttagcggacgaggggaagatagcgcaagacacacgtatagccgacctatcctatgcatcttagccgtcttatcaggattgatttgcggttcagtgaaagagataaccactgccaagctggaagaaatggctagaaggcactaaaaaaagagcctcgcagcgcaacttaagaactgtggactactaaggagcagcaatccgctggacgtgggggagttgaaagttggccggatactgcaacctgcttatctatgactcgatgagaccgttatttagtgcgatggtgccactgggagtgccatcaacggcaaagttgcagctttttgcagcagatcactggcttagacggcaccctcaagcggcactgaagaacggcgcgcttttttttttcttctattatgccggtcaaggaaaaaaagaaaccaaaaaaaaatgccgtgggaggcacggatgcaagatttctccaaagtccctttttagccgccgaggaaatgaggaaataaggggttagccgccgagtgaagccgccgaggtataaaagggagaatgcacaccttcgtaagaagattctatttgaaagagtgctaggtaaagtcatcaaaaggcttattgatataataattgctttgcaaaatggaaaacaaatgactttgaaaatgggagaaaacaaaaattatataggtaatgttgagttcttgattttttttttgtttctgtccttgccacagctcttttcatggaacattgggctctaggataatttttttatgttttctgttatgtttgccatggtaggttgaggtaaaggcgctctttcagcaatgacgatttatgctaatatgttttccttaaaaggaaaacatctcgttctttttttcgcgtgctgtgcaagaaaacgcgtaacgcagtcttagtaaaagggctctcttgaaaactacatgaaaactaaaaaagaagatgtaaatttggatacaacagcgtagaatagcataatagagtgtgcaataaacgtgtataggcttgataatagtgctgacgtaaattaccagaactactgcagtatgactgtggcgaataccgagacccattctgctgctaaaccatcgagtactataggcccatggaagcttggtgaaacactgggctttggtagcaccggcaaggtccaacttgcgcaacatgagcgcacgggccatagaacagccgtcaaagtaatctcaaagtccattttcaacaacaacggaaaccacagtaacgacgattcagtgctgccatacaacatcgagcgtgagattgttattatgaaacttttgagccacccaaacgttctgagtctttacgacgtttgggaaaccaacaataacctgtaccttatcctggaatacgccgaaaagggagaactgttcaacttgcttgtggaccacggtcccttgcccgagcgtgaggccatcaattgcttcagacagataattataggcatttcatactgccatgcgctaggaatagtacatcgggatttaaagccagaaaatcttttgctcgatagtttctataatatcaaaattgcggattttggtatggcagctttacagacagacgccgacctgctagaaacttcttgtgggtctcctcattatgccgctcctgagatcgtatcaggtctgccctatgaaggatttgccagcgacgtttggtcttgcggtgtaatcctctttgcccttttaacgggtagactacccttcgatgaagaaaacggtaatgttagggatttgttattgaaagtccaaaagggccagtttgaaatgcccaatgacaccgaaatttccagagatgcacaagatttaatcggcaagattctcgttgtagatcccaggcaaagaataaaaatcagagacatccttagtcatccactgctaaaaaaatatcaaaccattaaggattccaaaagtatcaaagatttacctcgtgaaaatacctatctatatccactggctgactcgaacaaccatactagcgcctctatcgatgattcaatcctacaaaacttggtggtactttggcatggtagacacgccgatgacatcgtatctaaactgaaagagaatggaaccaacaaagaaaaaattctatatgcgctactataccgtttcaaactggactctgtaaggggatcgaataagaagaaccgcaataagataaagaaaaccaaaaaaaataaaagatctagcacactttcgtcatcgtcatcattattattgaacaaccgaagcatacaatctacgccacgcagacgtacatccaagaggcattccagggaattctcttctagcaggaagagatcgtcctttttactgtcctcgaatcctaccgatagttctccaatacctttgagaagtagtaaaagaattacacatattaacgtagcgtctgcaaatacccaagcaacgccaagtggtgtcccgaatcctcacaagaggaactcaaaaaaacggtcaagcaaaagattatcttatatgcctaatacaaaaagaagctcactaacatcaaaatcattatcaaactttactaacctaatagatgatgatgattgggagtacattgaaaaggatgcaaagagaacaagttccaacttcgctacactgattgatgaaatatttgagcctgagaaatttgaattggcgaaaagagaaaaggctgaacttcaaagaaaagttcaggaagcaaaaaggcaatcagtgaatgcacagaagattaatgaggacgagtttggatccgaagtttctgatggaatgaaagagctgaaaaaaataaatgacaaagtgtcgtccccgttgataaattacgaattttcgcaacaagaactattgcaagatatagacaccttactaacgaatcgttatcaactttcgtcatatactaggcctatttcgagactggatcccggattaacgcctgttactgagacacttcctaacaacctaaaagaaaaaacagctctgctgcaggatactgaaaagaaaataatagaaacgatacgcagatccaaatttttaggatcgctactaaatgttagagggggactatcgccagggaaaagtgaactggcacctatcgaagagtctcccatagtttcaaccacaccactaatatataatgatcgaatggaacctcgtaggatatccgatgtggaagtcccacatttcacgaggaaatcaaaacactttactactgctaataatcggcgctcagtcttatctttgtatgcgaaggattcaatcaaagacttaaacgaatttttaataaaggaagatcctgatttgcctccacaaggaagcactgataacgaaagtaggagcgaagatcccgaaatagccgagagtatcactgattcaaggaatatacaatatgatgaggatgatagtaaggatggtgataatgtgaataatgataatatattgagcgactttccctcaaggcgttggcatatcacaggaatacgacatgaaggataaaaatccaaaccaatctccaatatcaaaaagcgcagagcccacactggtagtgaaacttccgtctttgagttctttccaaggaaaaaacgccagtgggttgggcctataccaaagagagccttctaaggtaaccttaccgagccttacaagtaataacagcagcgtcggagaaaacactagaggatggggcggaaaaagggactgagagtgagaaaatcgctgcttccctgtcagacgatgacttgaaggaagataatgacaagaaagataacgacacagtgaatgccctactacagtaaaaaagccacctaacagcgtactcttgaaaaaattctcaaaaggtaaaatcttagaacttgaaatacatgccaaaatacctgaaaagagactatacgagggcctacataaactactagaaggctggaagcaatacgggttgaaaaacctggtgtttaacatcactaatatgatcataacaggaaaattggtgaatgacagtattttatttttacgatctacgctttttgaaataatggttttaccaaatggagacggtagaagtttaattaaattcaataagaaaacaggatctactaaaacgctgaccaagcttgctacagaaatccaaattattttacaaaaagaaggtgttttggacaaataaaaaaaagggagggataatctatccccaaatggacaatacgatgtaacaccgttatataattaataaatgtatatatgtaactattttttgaaaaaaataaaatggtaatttattaaatatttggaccggtcaacaatctcagatatagttgaaaaaatctttaattgtaatagcagaaaaaaaaaactccgatacggggagtcgaaccccggtctccacggtgaaagcgtgatgtgatagccgttacactatatcggataacaaattattaaaattatttaataaaaagatgaactaatggtgtataaaaacatcataaaaactcaactcaactgttccaataaaatctgcaatttaaattaattattctgaaaaaacacgtaaattgttggaatggaaccctaaaatatttcctctttagtactattcatgttacttgagaaatgggtgaattttgagatagttgttgggattccattgttgataaaggctaataatattaggtatacagaatatgctagaggttctcctcgagcatataggaatcctcaaaatggaattagcatttctacataataacctcaattcccttttgtggattcacatattctcgatcggaactcctagcatagtgcagacaacactcacatagctctcccatttatcaagttggaattcactccaagaaattttcttgcttctctctttcccacagaaatgaaaaggaacagtttggcggctattgttttagcccttactttttggaccctttgaaaaaatgccaagaatgcgtgacggtttccctccatgctcgagaaccacaaaaaccctatgtggtattcgattatgcgactcacggcaaatatttgacttgtcaaagttattcgggatttccttgaatccctgagaagtgaaatggaaagaatttaagggcataaatacctttcaagcacccagaagaacagtaaaataaagcaaggtacgtgaaattaatatttttaaatggttctaaccgatgccgaagaactgcgcgatccggttataacgtctgacatgtccttttttgatttggaatccaaccactcagtgactctgtcattacttgcgaaattattccacaaattccatcgaaagtgaatcgcaaaccaccttcagactggcaccgacaaagcaaagattatacagacagagtactttatacgtaccgttaagtctcaagcaaagggttttcttatttactgaacgggtaaagagtatctgggccggcttgccaagatgcaaaccgaataagtatttcaaagttgcatttgccttagccgtcctgacaccattggctatttggatattttatattgactttcgtgtacattgatcacatcgactgttctattggcaaatgaaccacgggcattgactatttttcaggttactactatatattattgttggaataaaaatcaactatcatctactaactagtatttacgttactagtatattatcatatacggtgttagaagatgacgcaaatgatgagaaatagtcatctaaattagtggaagctgaaacacaaggattgataatgtaataggatcaatgaatattaacatataaaatgatgataataatatttatagaattgtgtagaattgcagattcccttttatggtgttggaataaaaatcaactatcatctactaactagtatttacgttacctagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttataaaaaatggaatcccaacaattacatcaaaatccacgttcttttcatatggattcctaaatcctcgaggagaatttataatatagtctgtatacataatattatagcttctaacgacaatggaattctaacaattatcaaattgccgccagttcctcaaaaagatccatgtataatcttcattattacagccctcttgacctctaatcatgaatgttctcaaataaatctgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttataaaaaatggaatcccaacaattacatcaaaatccacgttctcttcatggtagcgcctatgcttcggttacttctaaggaagtcccatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccgtctatgatgacgtgttcacattatcaaacgtcacctgcgtattatcaaccggacccacactatccgttgccacagtatatcccaccactgagtacttcctcacctgatccaatcgattcacagaatcaacactctgaagtacctcaagctgagacaaaggtgagaaataacgtcttaccaccacacactttaacatcagatgaaaacttttctacatgggttaaattttacatcagatttttgaagaactctaatctcggtgacatcattccaaatgaccagggtgaaatcaaaagacaaatgacttatgaagaacatgcgtatatatacaataccttccaagcatttgccccatttcatttattgccaacatgggtaaaacaaattttagaaattaattatgctgacatccttacagtcctttgtaaaagtgtgtccaaaatgcaaactaacaatcaagaattaaaggattggatagctcttgccaaccttgagtacgacggaagtacatctgctgatacatttgaaattacagtcagtacgatcattcagaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcagttaatatatgacgaaaataaaatcatgaatctaaataaaccgtcccaatacaaacaacacagcgaatacaaaaatgtttctcgcacatctccaaacacgactaacacaaaggttacaactcgtaattatcagagaacaaatagttcaaaaccaagagcagcaaaagctcacaatattgctacatctagtaaattctcaagggtgaacaatgatcacattaatgaatcaaccgtttcatcacaatacttaagcgatgacaacgaacttagtcttaggccagcaacagaaagaatctaagccaacacacacaatagactcgaatgacgaactacctgatcaccttcttattgattcaggacgttcgcaaacgcttgtcagatcagcccattatttacaccatgcaacacccaattctgaaataaacatagtcgatgctcaaaaacaagacattcctataaatgccattggtaatcttcacttcaactttcagaacggcaccaaaacatcaataaaagcactacacacaccaaacatagcctatgatctattaagtttgagtgagctggctaatcaaaatattacagcctgctttaccagaaacactttagaaagatcggatggtacagtcctagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaggaatcggatattgaatggtctaacgcatgcacatatcaatgtcctgactgtctaatcggcaaaagcacgaaacatagacatgtcaaaggatcacgactaaagtaccaagaatcatatgagccttttcagtacttgcataccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatccgccgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaagcaatccaaattggaccaattcaattatgatacactcacctttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgacttctcgtcccaatcaataaaccctttacaattagacaaggaaccagtccaaaaagtacgtgcaccaaaagaagttgatgccgacatatctgaatacaatattcttccatctcctgtacgatctcgtacaccccatatcattaataaagagagtaccgaaatgggtggtaccgttgaatcagatactacttcacctagacactcgtctaccttcactgcacgaaaccaaaagcgacctggtagtcccaatgatatgattgatttgacctcacaggatagagttaattatggacttgaaaacatcaaaactacacgtttgggtggtacggaggaaccatatattcaacgaaatagtgatacaaatatcaaatacaggactacaaatagtacgccctcaatagatgaccgttcgtccaacagtgaatccactactcccatcatctccatagaaacaaaggctgtatgtgataatacaccctccattgatacggatccgccagaatatcgatcttctgaccatgcgactcctaatataatgcctgacaaatcctcaaaaaatgttacggctgattctattcttgacgacctcccacttcctgacttaacccatcaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacttataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcactgtcaatcgcattagacaacgactattatatcacacagctggacatatcctctgcttacttatatgctgatatcaaagaagaattatacataagacctccaccacatttaggtttgaatgataaattactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaagtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtacatgaaatgcaaaagttgattggtctagcttcatatgttggatataaatttagatttgacttactatactacatcaacacattgctcaaccatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcggtcagtgaagctattccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaactaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctcaatcctctctcttggccaccaccggatagtaaaggttctaatctaactcttggtctccttcttacatagatggcacctattccctttggaccgtaaatcttgtgagaagaaattgatagtaaatcaatgttcatttcattgacatcaatgtgaatcttaccataggcttgtgcggcgtcagtatgaaagtagatcttattctttctacaaattgcaccaatttctttaataggttgaatgacaccgatttcattattgacagccatcacagagacgagacaggtatctggtctaatggcatcttccaattccttcaaatcgataagaccttgatcgtccacatttaggaaagtgacttcaaatccctccttcatcatggcccgtgcggcttccaagacacacttgtgttccgttctagtggtgatgatgtgtttcttagtcttcttataaaatcttgggacacccttaagaaccatattattagattcggtcgctcccgaagtgaatattatttccttggggtcggcattgatcatctttgctacgtaagctctagcattttccacagcagtatttgtttcccaaccgtaagagtgagtgttggaatgaggattaccataaagtcccgtataaaacttcaacatcgtatccaaaaccctagggtctgttggtgtagtggcttgcatgtcaagatatatgggacgagtaccaaaacctgtgttttcttgataagcatggctcattgcagtgctaccagaagctactacagcatctggggtggtaccggatgcactcgcacgggcactagcctgtgcctttgcagcagcctgaatatcggtatgcgtttccagagagaagttgtcgtctaacttcacgcctgctgcaggaggggaatagaatctcctgcttaccaaacaagccctatatgtggccgctggaacgttgtaaacttgagataatcttgttatcgatcttgtagcagttgatttcaacatcttccagttgtagcagttccttcgtgtatgcgatatattttaatgaaaatgatgtatctgaaatagaaaatataacacataatgaactctgtcggtctttactctgagtgagttacttagatagtcatcatatatccctgggcgatggccttactatttgtcagcgaccgtatctaaaattggtaggtcactatcaactattgcgggtaatagggtgccataatagtattgtaatatatataaatatataaagcatcatatgatagatatttgttgctattcacgtcatccactattactttagtggttccgctatatattcgcattgcccatcgaaggcagttttgtgtgctacctgctcgtgaccacggtctttttgcccagtcttttacggcgggcatacttcatgatgaaactgtctattttcatacctcttgaatttagttcttcaattagaggcttgatatcctccaagtcccactgtgactgtagcctaaacaggactttaaaccgttctttggggtccattggtagtgtgcttttcgctatatactggacagtcttatcggtaggcttgaaatgatagcctcgcagcatgtcaatgtcaatgtcacatgggaagaaaggtgggaaaagggacttccacttgatgaggaactcatcaattggcatgcttattccagaaacatatttccttagcgcttgaatcccgtaccactgagctataaacggtattctcaagcgccacgtattgttttcagcctcttgctcttgaacagcaaatttattcagcactgtttcaatgatttctcttgtgtatggattgaactcgtcctcaatgtccttccccacagcgtgatgtgtatcctcaacattcagatgctgtagatcgagtgattctgccattgcgctcatcagtagtacatgcagtgctttgaaaaggaagtcttgtgaaagaatacacaacacaccgtctttcacagatccaccaatcttatgccattttgatataccttctagcgcagaacatggtgagttctcaagtagttcttccagggtcccgataacctttgtagatgacctcttcatgattttgtcggagaaatccagttctccgttgtatattggtactgaattcaagttcaattcgccatgtgtctctctggtctcaaattctgattcagtcttggcgaatcccacgacgtccatgtacggcttggacagtccaaacaagagcgtttcgtcgaaagtaataggttgttcaggaacaaattctctcattagtagaactgtgtttgaatgtttgcgctgcttgcagcacccaagtcttgtcgtgcgaacacagtacaacttcagacttgtctttgtccaatgacttaaaccttaactggtgattttgaaccggatcctgtattatatccagtaactctggtgtcaactggatcagcttataagatggatcatactcgggtgcggaatgtaggttgatggacatggtacaggattattagtgagcaaatctctggtggatttttaccgttcatctcatagtgcttttttagtttatttttcacttttttctggttatactatacgctgcctactgaagcaataagcaagaaacacaacagtataaagggacaaagataataaaccgcctactactaaataatatcgctgtggtatgctactcctagagatttcgatcaccatcgtggtgctctttgtcatacgcatagaattgacaaaaaagaaccctaagctataaattaggtcatgttgagcgattgccagttgccaagacctagggttttgttcgaacaattctaaaaaggtaaataaaaacaatggtaaacaaaggctttgatcttcaatgaggaagatttctctcactgcggatagtaaaaacaacactagtttgtctgtactcgcattctactgctgctacctgctactcattacgtgttcgggctgttatctggttgctaaaagagtatatttacacctcaccaatggagaaagacctgtcgtctctttactctgaaaagaaagacaaagagaacgatgaaaccttatttaacatcaaactatccaaatctgttgtcgagaccacaccgctaaatggtcattcattgtttgatgatgataaatcactttcagactggacggataatgtgttcactcaatcagtattctatcacgggtcagatgacttgatatgggggaagttctttgtctgcgtgtacaagtcccccaacagcaataagttgaacgctataatattcgacaaattaggaacatcatgcttcgaatccgtcgatatatcttccaactcgcaatactatccggccattgagaatttgagtccaagtgatcaggaaagcaatgttaagaaatgcattgctgtcattctgttacagcgctatccattactttcaccatcagacttatcacaaatattgtccaataaatcggaaaattgcgactatgaccccccttatgctggagatttggctagtagttgccagttgataacagcagttcctccagaagatctggggaagcgcttctttacatcaggacttctgcaaaatagatttgtcagctctaccctgttagatgttatttatgaaaacaatgaatccaccatcgaactaaataataggttggtattccatctgggtgaacaacttgaacaactttttaacccagtcacagaatactcaccggaacagacagaatatggttataaggcgccagaggacgaattacccacagaatcggatgatgatcttgtcaaggccatttgcaacgagttattacaactacaaacaaattttactttcaatttggtagaatttttgccaaaattcctgatcgccttgagagtcagagtactcaatgaagaaattaatgggttatccacaaccaaattaaatcgactcttcccacctacaatagatgaagtcacaagaatcaattgtatttttctagactcgctaaagacagcaatcccttacggttccctcgaagtactgaaggcatgcagcattactattccttatttctacaaagcatatacaagacacgaggcggccacaaagaacttcagcaaagatattaaattgtttattaggcatttcagcaatgtaattccagaaagagaggtctacacggaaatgaaaatcgagagtataattaagggacctcaggaaaaactactgaagctaaacttaattatagagagattgtggaagtcgaaaaaatggagaccgaaaaatcaagaaatggcaaaaaaatgctacaacaatatcattgatgtcattgattcgtttggaaaattagattccccacttcattcttatagtaccagagtatttactccatcgggaaaaatccttacagaattagccaaatgctggcccgtagaactgcaatacaaatggctgaagagaagggtagtcggtgtgtatgatgtagtggatttgaatgatgaaaataagagaaatttattagtcatattcagtgattatgtggttttcatcaatatactggaggcagaaagttactacacttcagatggatcaaacaggcccttaatctcagatattttaatgaactcattgatcaacgaagttccgttgccctccaagatccctaagttgaaagtggagcgtcattgctatatagatgaggttctagtttctatattagacaaaagcactctacgttttgatcgattgaagggaaaagattctttctcaatggtatgtaaattatcctctgcatttatctcttcttcgtcagttgctgacttgattacgaaggctagaattttggaaaaagacactgcatttcatttatttaaagctagtagaagccattttacattatattctactgctcacgagctttgcgcttatgattccgaaaaaataaaatcaaaatttgccttattcctgaacataccaccatccaaggagatattggaggtcaacaaccttcatttggctttttttgcaagattttgcagtaacgatggtagagataacatcgtaatcttagacgtcttaaccaaacatgacgataaacatatagaagttacatccgataacattgttttcaccataattaatcaattggccattgaaataccgatatgcttttcttccttaaactcatcgatggccaaagatttactctgtgtaaatgagaatttgataaaaaacttagaacatcaattggaagaggtcaagcacccttcaacagacgaacatagggctgttaatagcaaactttccggtgcatccgatttcgatgctactcacgagaagaaaagatcatacggtaccataacaacatttagaagctatacaagcgacttgaaggacagtccatcaggcgataatagtaatgtcaccaaggaaactaaggaaattttaccagtgaaacctacgaaaaagtcttcaaaaaaaccaagagaaattcaaaagaagaccaagacaaacgcctctaaagcagagcacatagaaaagaagaagcctaacaaaggcaaagggttttttggcgtgttaaaaaatgtttttggaagtaaaagcaagagcaagccttcaccagttcaaagagtgcctaaaaaaatatcgcagaggcatcctaagtctccagtgaagaagccaatgacctcagaaaagaaatcctcccctaaaagggcagtcgtttcatctcccaaaattaaaaagaaaagtacttctttttccacaaaagaatcacaaactgctaaatcttctcttcgagcagttgaattcaaatctgatgacttgatcggaaaaccacctgatgttggaaatggcgcacatcctcaagaaaataccagaatatcttcagtagtaagggatacaaaatatgtctcctacaatccctctcagcctgtgacagaaaataccagtaacgaaaaaaaatgtcgaaccaaaagcggatcaatccacaaagcaggataacatttccaattttgcagatgtagaggtatctgcgtcttcttatcctgaaaaacttgatgcagaaacagatgatcaaataattgggaaggcgacgaattcgtcatcagttcatggaaataaagagctgccagaccttgctgaggtgactacagcaaatagggtttctacaacatcggctggggaccaacgtattgatacccaaagcgaatttttacgtgcagctgatgttgaaaacttaagtgatgacgatgaacacagacagaatgaaagtagagtttttaacgatgacctctttggtgattttattcctaagcattaccgtaataaacaggagaacattaacagctcgagtaatttgtttccagagggaaaggtgccccaagaaaagggcgtatcaaatgaaaacactaacatatctctcaaaactaatgaagatgcatctacattgacgcagaaactctctccacaagcgagtaaagtgctgacagaaaattctaatgaattaaaagataccaacaatgaagggaaggacgcaaaggacataaaattaggagatgattacagtgataaagaaacagcgaaagaaataactaaaccaaaaaattttgttgaaggaataactgaacggaaagaaatattccccactattcctaggttagcgccgccagcttcaaaaattaactttcaaaggtcaccatcctatattgagctctttcaaggaatgagggtggttttagataagcatgatgcccattataactggaaacgcttggctagtcaagtctccttaagtgagggactaaaagtcaatactgaggaagatgcggcaattataaataaaagtcaggatgatgccaaggcggaaagaatgactcaaatttctgaagtgattgagtatgaaatgcagcaacctatcccaacttatttgcctaaggcgcatctagatgactcgggtattgaaaaaagtgatgacaaattcttcgaaattgaagaagaacttaaggaagaattgaagggcagcaaaacggtaatgaagatgtcggtaataataatccatccaattctattccaaaaatcgagaagcccccagcattcaaagttattagaacatcgcctgtgagaattatcggaaggcacttttgaagacactagaaaatatgaaaatggctctccatctgatatttcgttcacttatgatactcacaacaatgatgaacctgacaaaaggctgatggaattaaaatttccatcccaagatgaaattccggatgacagattctatactccagcagaggaacccactgctgaatttccggtggaagaacttccaaatactccgcgaagtattaacgttacaacttcaaataacaagagcacagacgataagttgagtagcggtaatattgatcaaaaacctaccgaactgttagatgatttagaattcagttcatttaatatagcatttggaaatacctccatgagtactgacaatatgaaaatatcatccgacttaagttcgaataaaaccgtgttaggaaatgctcagaaagttcaagagtctcctagtggaccattaatctatgttttgcctcaagtgagcacaaagcatgagaaagaggggttccttcgaaagaaacaaaaagacgagcccatttggtttcccctagcaaaattgactttgctgatctaagtaggagaactaaagcattgacgccagagcgtaatactgttcctttgaaaaacaacgacagtagaaaatacaaatatactggagagggatctatcggtaatatgacaaatatgctgttaactaaagatgcttcgtacgcgtacttaaaagattttgttgcgttgagtgacgatgaagatgaagatgggaaacagaactgcgctgttggtggcccagagaaactgaaattttattgagtgttttattgattttttttttctttttaatttaatgcaatgtatacatttacataaaatatggacaaataagaaaaagggggaaaaacctcccacttaagtaaaactgaatatattagatacctttacctactatcaaaggtgaatgcttttggatcaataggggttccatcgggggcaataccattttggccgaactttctttccatatataatagtctagccttatcgaaatctacattatcgttttccataatttgtttaatctcatcttggagacatcatccaaaccacctcttacgtcgttgctattctccgagataatatcgaaattcctggaatggagaccgttttctaggtcatcagcaaaggaatcatttaaacgtatatgtctattaaaacgtaattgtattcttgaacgcagtcacgaaatttgtcggctattacagctgttagtatttgatacggtttgcactttgcattttcaaatgcttaaatatactaccaactttggttttccggtgtgccataagaaggcataaagacaatagcacaacccagaggagcaatttgagatagaacaaactcttcatactcgtatttgcaatttttggaaattaattgtgtagcttttcttctcttaattggtggcagtttttatatattcagtttagaatcccttttttttttttttttttcttcgcttttcgcatctcatcgctggaagtggtgcacttttacagggattaaataaggttattctttttggtcaaaatgataaatataactattaaagttatttataacccgcccgcttccttattatttatacgttatcataaagtacacaggtcatggttcggttggtgcttaggaattaatcacgtctagcataagagatctgtaaactacaaccaccataattataattatttaatttttgaatacaaaaatctgcatctactaaattttcatattctacaacagcaacaccagttggttgaccattttcctgtggtttcaattccgcgttattgattttgccgataggcccaaacaagtcgaataaatcgcttcttgctgttgagaatggtaaattactacaataaatgaaacagtttctatcccctcctggattgacaccttcagtaaattttgctgcagtttcatcaatgtggacagcggcatcctgcgcaagacctggttcagtacctctggtatcttcaaggtcctcacgcctttgattataacgatcattgttctttctcttgttgaaacgcccttctctaacttccaaaactctaccttctacttccatgccgttgaatgtatcgatagctctaatcatttcatcctcagtaggataaatgacagaaccgaatcctcttgaaaatccgttgaaatccaattctacatcggcacgcaagacatgaccacattctttaaacatatcttttaaggattgccaattcatagagtacggtaaattgatgatgaacacttcaaacccattatctatttcttccctagtagctttcttagaaaattccttggcagcttcaggaggaggattatcctgtcttaccattagtttccggtccataaagagggcaccatcaaacttcgatatggcatcttggacagattcgtttttggtaaattccacagtccccataccacggtgatggccctttgatgtgataatgtcagcctccacaacttcgcccactgtaccaaacaattccttaaggtcttcaggggtacaatcaaaagtcaagtttctcacgaagatactattttcaaaatttctcttggtcgcgtcaaattgcctttctaagtctctttcaacaattggacctaaagtacgacccctaccgccaccgcgtccccctctgaatgatctgcttcctcctctgccacggcctcctcggcgagggggccagttcctatcatcgtggtagcggctgccaccataactctgatcgtaccgatcattgaaacgggagcctcggtcgcgtctctgacgacgactgccattaccattattactgctactatcgttataatcatcgtacctgtctctgtcgtcgctcaaacgacgacgtacaggtgatcttgatctactcctatcatttccatacatccctagctctctctccatcttggcgaaaaaatccagctgatgtttgtttccttttcgcccatagcttatttctaatgggaaatcctcaatataattgatttcatccaagctttcatttttttttcaatttttttcaccttcaagtgaatacatcacttccgacgataccaaaataatgacaaaatgccatgagaagatcttatgatatgtagtaaatgttaaccaccattgctatttccttgctaggtttgccaaagccgttggcgaaggcagcactagacggcgagtcacttccgtctctttgtccacttcctcttcaccatcaaatcgaagcctgcaagtgccgtccctcttggttccgatgacaattgcaggataaaaagtggtcgtttcaggatatcttgccagaaccttagtacctggcgggtagttcttagtgggaaagcctggcgggatcaacagtagttctttccgattacatttatacaccttgcctgagttgcccaattcatcaggttcaggatctctcacttcaaatcgtgtaccatctgctacgactttgagtactcacactgtatcattcgccgtcgcactgccccttctgggcttataggcaacctctgagcccaccaaaataggtgcatttgggttgtattcgctggtccagtacgatctgccaactttccccacagctttcttgccctgcgacaatgccatgcgtgtcccttctccttcttctgcatcttcagtattttcctcactcttttcctctcgtgactgattcaacatcaacgacaaattggaacgtacattgtcaaggattcggtgcactctgttgacgttttccatgtgttcttggaaagtgttgagatgcaattgcagctgatcctttgacatattaaggaaatttagtttttttgtttgcagctcatcatcaaagggaatgacctcgttggcattgtatatgtcttgcaaggacgacactacaacatcccaatatccgtccataataagaaaggtgaccgtgtgttttgctgtgaaaaactccccccacttagagaagccaccaaggtattgtgtctttaacctttttcgtatctggcaaaatcgaagaggaaagcagaaaaccaaaagaaaaaaatagtttagtaacgcgtcacctcgtacaaacgtacaatcatagcaacttatgagtaaataggctcatggttatagatacgttatatagatgtatagaggagagtcccgagggcgatcgcaaggccgagagactaacctaaccaggtggtagttgggaaatgtcgaccatttcgctgatcttttcgtcttcgtcggcagcttcctcggtgcttgtcttcaaaggagttcttggcaatgccatcataccgcttcttgcacactctaggacaccgaatggctcgaccaacttcaagaaggcagagatacgtgtgggttttgcagacaattccacaatacagcttgtttcgctgatgtcgacgacacgacctccaaagttgttggtcaagttggtgatatcgttcaaatgctcgtgcttcaaccttaatacctcactggcgggcaagttggcagggtggaattgcttttctctgatttcggcgaccaattcttgggagtcagcggcgccagcattggtggaagtgtggtggtgcaatagtaggtcttcgaagtattcagtacccaatagagagattctggccatcactagctctcttttgatgatctcagaattggtatagtctaggacggcgtagacggggaccaagtcttcgatttgtctgcgtgcttgttcgactacgccatcttgcccttgcaaaacaatggtcattctacttaggtctttgacctcggtgttgcacacgaccaacgaatcgatgttaaagcctctggcagctaacgtacccgagactctggacaagacaccgggttcgttttgcaccaaacagttcaagacatgctgttttcttggttgacgagaaggcgctggtgtttcgtaaatgatggatgaaacggcactgttggcattccaggaaggagtgtctagtgtgggcaagggaggtcttgttgcgtgtctgtgcatctgcttgtacgccaacgcggaggtcgacgaggaactgcaacgcaccatggtagcacatgaagaagcaaccaccctgcggtggccgctttgcaataacgatctcagcattagaaagactgggttagtgagctcagatgttctaaagattctgtatatacgaactatgtacttccatatataccattccccgttcttgttaggtaaaggttaaaaaaatattttttatggcacttcggcgatgcgaaagaaagtgagtcacgataacggtgaggtgattcgttggatgtgccatcgcacaaggaattgctggcgtgctaattcacgaccttgcttgacaaaagtatcgaggggaatggtgccacggtgcagcatcctagataagcactcaatggtgtccgtgagagcgtagtcctgggcaacgaggttgtatagttgattgagtccatctgttttggccactgctatggagttcacgtcctcgtcatccacatgcgaagttgagctaaactgttggactttggccctatttgcggttcaggacgtctatctgtgcgtttagcgagtgcatggtctgctcaatagcctgctcaacggctcgtaaatggttcttgtcgatggcgattatttcatggaatctggcaattgattcttgcatgacggtctgtctcgtcagtatcttgtccgctacatagtccacatcctctctgtataactcattgactacggtttgtagattttgtagcatttcatgatggttggttggggagatatccgtgttgtccatgtccataaggtcgagtgcgttagatgccggttgaggtggtggaggtggaggcaatggcggttttaggtgtggagacttgggctttgggggcagtgggggagtattctccctcctgctggagctgcgtattgggcttagggggtagactgggggcctgatcttgtggcggctcgtgtaagagactcattaattcttgtacgaccattataaggttcatcgcggcaggatcccagcagtggagtatgggcagcgcaatccacccattggagtcgatgtattcttgaatgggcaaggaactactgatggtgttcatgtcgaaattttccaagtttatacttataaagggaggttttaccgggtacatactgggtacccacatgatcacaggaatactgtgaggagatgaaccatcctcaccagtactaatggtaccatatatggacaacagtagttgtggagtgccgtcagagtgcgtaaatacccttgttcttggccttaaactgtgaaaattgtcagcagcgctaaagaatcgtggaaagttgttcttccgtcgttataaatgggttgaatgaactttgaacagccaattgaccaccgcctgggaacagagatcttgccgtttgcagacatcgttgctcttcactctctctcttttcttggccgttaagataccaactgcccacaaaattttgccgtaactttttattctcgctctgtgaaaaaagactactacattttttgaccttttatctatactttaagaaacaaaggtccaacgaataataaagaacaaagagtaatgagtagtttgtatgtgtcataatctcttctctccgcttcccttttcttccttcttcttctactaactctctgcgcgtccaatttagctatactgttgttggtgtattcatagtggttagtgccatgtccgtgctgttctggataatggctccaaagaacaaccaagcgtatgtgcaacattttttttacgatgtgtctccatattactagtttccctttcttttttactaacaagagtttgtttgttttgttttgtcgtacagtgtttggagaagtacagtgattttgacattggccatgatgtttttgatgtgggccattacgttcctttgccagctccatcccttggtggctccacgccgttcagatttgagacctgaatttgcagaataaagcgtcgagtatatcaagccaagtgacgtttcctgagtataagaaaaataagcaaaataagtatacataaaaataaatacgaatagaaatatagtggcatctaaacaacccagagattttttgaaaaacacaatgagtatatactgatagacaaccacacggtctttgaaacgagacgccgtctacggttgtatcaaaatgtgtaaacgggccatttcaaagcttgatcttctccataattagaacccatgtcccgtggaagcgttttaaaagacatgaggcagaaacaggagtgtgatatccttgcatgcgcaagttggtaatacactgcacaaaacacgcgtgtgcacatacacttatgtggttcaccgtgccgctgctgtgtttatctgttgctcgacatgtgctgctaatgattatgttggaatagacaaacaatttaaagtaatttcttctttttttatagtgagaaatctcaaaagaaaaaaaaaaaataaaaaaaactaaagagctgccgggtgagcaacgactaaaagaagaaaccatttagggcttcatcagcaacttgtaggaggagaaagcagtatataactagccgcaatatgtttgtggtggattggagcgtgcagctatgcatgggagtgatttcacctctcttccgtgccctcgtgcaactgcctttatcaattttcgtatggaatgggtttcagacttgtgcattgcctatcaacatcccattagttgttcctgggacgtcgctgagccgtttagttgcacaaacaagcacattagacttctatgtggttttgacgttgtttcaatattttgctgtgctttgtgcttttggcagcatcataggactcatctttggatttatattgggtgtgttccactcaatctgcggggtacccagtgtatacataagtctagaatggaaacggtggtttgctccgatacgtacggtccttgaacgtgcttccactagtattgtcaacattatgcgaggacaaactattgcgccaatacccatgcctaagcccaatcccacgcatatatcaaagcctaacatgaaaaaattccatgatgagcctggagctgatgatatgactataacgcatgatgtgaactgctacatcaccccttgccaaacgcctactaacgaaaaaattcagcattataataatgattcattcaacacgaccaccacagacgatgaacccactgatatttgggataggtctgacacttaccaaaactcattcgtcaccaatgaaactttgatgtctctttctaatagagctaagcttcgaagaaatgccagtgatgcggacatcgttaatataaagattttacgaaaggaattctaggtgatattgcaattacttcttctcatgcactaacaagtgaatgatagaaatatgttgagttgctaactgcctgattttaaataagtttcatattataatcttttagcatatatatatatatattgatcctctctcttctttattttctgccagtaacccatgtgtgaagaagaaaacataaataaaaaagcagtagcacatggacacattcacgcccgaacacttctaaaaagcagcccacacaagaaagtagatataatgtaggacacccagcttgtccataattgctaatagcatactcaggataacatatattaatgacgactcgtttgctccaactcactcgtcctcattacagattattatccctacctctccagaaacccttcaatataaaaagggcagatgtccgctgcgaacccttctccatttggcaattatttgaacaccatcactaagtccctacaacagaatttacaaacatgctttcatttccaagcaaaagaaatcgatataatcgaatctccatctcagttttacgatctcttgaagacaaaaatacttaattcacaaaatagaatattcattgcgtctctgtatttaggcaaaagcgagactgagttggtggactgcatatcccaggcattgaccaagaaccccaagttgaaagtttcttttctacttgatggccttcgaggaacaagagaattgccttccgcctgttccgccactttattatcgtctttagtagccaaatatgggtcagagagagtggattgccgattgtacaagacgcctgcttatcatggttggaaaaaagtcttggttcccaagagatttaatgaaggtttaggcttacaacattgaaaatatatgggtttgataacgaggtcattctttcgggagccaacctttcgaacgactatttcaccaacagacaagatagatactatctctttaaatctcgaaacttctccaactattattttaaattacatcaactcataagttccttcagttatcagattataaagccaatggtggatggtagcatcaacatcatttggccagattcgaatcctactgttgaaccgacgaaaaataaaaggctgtttttaagggaagcatctcaattactagatggctttttaaagagttctaaacaaagcctcccgattactgccgtgggtcaattctccacattagtttacccaatttctcaattcactccactttttcccaaatataatgacaaatcgaccgaaaaaagaacaatattgtcattgctttccactataacaagcaatgccatttcttggacgttcactgcaggatacttcaatattttgccagacatcaaagcaaaactgctggcaacgccggttgctgaggcaaatgtaataacagcttccccctttgcaaacggcttttaccaatcaaagggcgtctcatcaaatttacctggtgcttacttgtacctgtcaaaaaaatttctacaagatgtatgtaggtacagacaagatcatgctattaccattaagagaatggcaaagaggcgtagtaaataagccgaatggttggtcatatcacgcaaaaggtactttggctttccgctcgtgataaaaatgatgctaacaattggaaaccctttatcacggttataggatcttcaaactatacgagaagggcgtattcattagatttgaatcgaatgctctcattattacaagagatgaagagctaagaaaaaaaatgaaagcagagttagataatttattacaatatacaaaacctgtaactctagaagactttcaatcagacccagaaagacatgttggcactggtgtaaagatagctacctccattttgggtaaaaaactttagattctatcatagtatgtcgcctgtaaatatggaaaaataaaagaaaaaatgataataataaatgcattatctaaaactccttaaatttgcaaacatcgcaaagccattaaggtagagaatgagctgaccttgttatagttttccttttggcaaccgtggtttccgtcctacgtaaacatactgaacttgacaaagtatgaccaataggtgacaaattgtatcaattttacccaaaagggcgttgaattaaatggtatctcgtaaaacaatgcattggatcggtattaccagtctacctaataaatcgatagattcagccaaaaatgatatcaatgcaaactttgatgataaacctactgttgagcatcccatccagtttatactcatttgaggcacatacttgaaacatttaagcagatttgccattacccacaaataatttatgtgttccaaatagaaaacgccaaatttacctgaatttttcaacggtaaattagagatggaacagccatatgtaaatatgcctaatacaaggaacacacttataattattatggaagtaatggaaatgccctgataaatatgtttagttgacctataatagtataactgccttaaaaccatcatgcagcaacaggaaacgcaaaaatcttttagaatgaggaaactggatataggtatactacgggcatcattcaacggataaaaaagtgggaatctttgagacagttgttccctcaccagagatgaataacaataatgcaacgcgcaatacaagtacagaccattaccaacaaaatctagcagaaataaatcatatgaaagcccgtaaatagatcgatgaagtttattatagcgcttttgacatagaatggcgatgatctatgtaagaaatggaagttttctcccttagttagtcaaacctttcatgtatactttctccttcaattatgcatactgataaaaaacctgccaagccctgcagaacaataacaagcatgtgaatgattcaatataattgcttcgcagggctcctcaacctctcctctggaaaaccttacctcaatgaggttaaaaattgtgggtttttcgttcgcagaggaaaaaaaaacttgtcaaaacacgcctctgcagtagaacacgaattatacataagaaaaataacgatacaagaaaggcgatttcgatttgggactaagtgttacacgaaaggcatagagtatcaaaaaaaggaagtcaagatggattacgatagctctgatacaatgaacggtggttcaagtaaccccttaatcactaagatgaatacaatgaaattattatatcaacactatttggataaagtcactcctcacgctaaggagaggtgggctgtattgggtggtttgttatgtttgtttatggttcgtattacaatggccgaaggctggtatgtgatttgttatggtctaggtctatttttattgaatcaatttttagcctttttgaccccaaaattcgatatgtccttacagcaagatgaagaaaacaacgaattggaagctggagaaaaatcagaagaattcctttccattcatcagaagacttaccagagttcaaattctggtataacagcatttagagccactgtcatttccctcttgttgtcggtattttcaatcttcagtattccagttatttttgcccattctttatttgattgttattttcattattattgttttttttaactatgagaaggcagattcaagcatatgataaaatatagatatatacccttagatatcggtaagaagaaactattctcattcttctaactgatataccctgactccacatacctattcaacgaacacattcgtatcttaattatatgtaaacaaaattatatgatagttacagaataattgtgattattttctccttctactcatcttctcttatattggaagaatacatgaagttattgattaagcaaaattgaagggaagaggctcattttcttccatttataaatggagagcttgagatgcctccaattgataaatttttgtaaagactttcaagaaacatgtctaaaaagaattgacagcttcgaacctttctgcataattactaataccaaattagtgagaaatggggtatgtcgaggaataaaggatgcaaaagagagagtaatgtcatgcaagttgtgagtttgaaatgttcacacgtttataatgtcatactcgtggcgtgcatgtgttttagtgtattagtttcagttattaaagaacttagtaaatttatcatcgaacgcattttgattaagtggcacaatagacttcaatggaaaatgaaaatcatatctgtagcaaaaacgacagcgaagataacggttacacaattatcacgttgattcgtcaacttaaagatgacctttttacaatttatcaataataatagacaagaaggacaaggttatatttcagaaaaattattcaaaactaagaagaatgagatgataagaaaaacagttaccaatttagtagctgtaagattaaaaaacttatcccacgaatttgatgtaatagagaattatctgcgctatatagctagcacagtgaacatctatttactgctattaagcgccactttaacaaatgtgccagaaaacttttgaaagaagcaatcgactccaaatcaaactcagaaactgctacggtggttctgcaagaaggattttctggcatttgcttattgaaagcgtcttcaattatattaaaactaaaattgaagtttccaaaaaagaaagatagaactgatattagcaaattgtgtgacaagaaagaacggatgacacagtggttagaaatttcaattttgatgaactgagaataataatattatgctcccctggattttatgcgaagacactgctgaaaaaatttctgatatatgcagagaaggagcaaataagccttttaaggaaccgagataagctgttttcgcccattgttctagttctacaaaatatctacagggaatcgatgaggttgtaagaaatcctgaatactctatgatagtgcataacactaaaaagttgaaagaatcccgtatcatggacgatttccttgaacatttgagcaaagacgataacaaagcatggtatggcgcggaagaaaccgagagagctgcaaaattagatgcaatagaaacactacttattacagatagtgtactaaaaaggaacgacgtgaaaaaacgtgaaaaatacctagacctaatagagaatagtggaaacaacaatggcaaaatattcgtactcagtacttcaaaaatcacagtgagcaacttgacaaaccaacagatataggctgtgtcttaaaatataccatccaataccttgatgaacttttcaaagatgactaaaataagtgaaatttcaacattaacttcgaatttttttctttttatctaacacttgtcaaacagaatataaggattacttgtcttctttgctacatattgctaccacttctattacacaatagtttcaatagcttgcagcgtagctaaactctaaaatttatctaaatcactcatataaaccgaacccttccccttccgcttatagtacagtacctatacatttcataaacatggcatgcgatcagcgccaaacaatatggaaaatccacagaaagctattcattgaaaaaatagtacaaataagtcacatgatgatatttgattttattatatttttaaaaaaagtaaaaaataaaaagtagtttatttttaaaaaataaaatttaaaatattagtgtatttgatttccgaaagttaaaaaagaaatagtaagaaatatatatttcattgaatggatatatgaaacgtttactggtggaagttttgctcatatattattattcaatagaagtaataaagaaaaagttggtaaagcaacttaacagtaaaaaggtaatgattgaaaaagtttttgaacatctaagctatatgttgatgggtttacaattttaccattagtactcatgcctatacttttctgttcgtccttaatgtccgcgatttagagcaatcattgaaagtactagatacattttagccagagaggactcgttgacgtagaattaaaattcaaatgaatttccgccccattcatataccccaaataacaaacatattaaaacttcataattattcaaaatgtggagtagtatagaagagcagtaccttcaaaattgatttcttcagtttcccacccgggatccacttgtcatgcggtgagaatcgtatattgcgtataatccgtgtttcatcacccacattatagtacaaacctactggtgtaaccattatcatattcatgacttgtagttaaaaatctttcacgataaattgaggaaaaaatcacgttaaatagtttcatatcattctttagttaaagtctgtgcataaaaagaggatcgggtgttgtactcgttctatcaaaatattgttattgttgcattatcacacgaattacaatcaatttttttatctacaggccagagtacctgaaataatggaattagattcaaaaaggatagcttaatcggtctttatactaattattttacgcccagaacgaaacataacgtgcattaaatctcactgtcacaacattgtatataatggtagcatcgtactaactattggcattcattcaatattatacaattatcttattaatactttctcaagtagtcttgaagaccagcatgtaggaaggtgatgatatgctccgtaaataattggaaatattgagatataataacgatgacaatactaacaaaagtaataggtgagctccgccaattgattgttttgttttgaatatatattgatgcttaacaatttagtcgtcaaatagcacctgcaaaacctacctcttacaggctttttttcaatttactccccatgtgggagttctacgtaaaccacttagaatgcagtttctcttctaaataacatgttatatcttctgaagaaattgaaacatattgattcttatggtgagagcaatttatcaatgttttatcttaagttctactgcccttggaaattatgtcctttgcttcccattttatatggaagaaacaaatcagtacaaaatgcttggtcatgtcataagcttcatcgatttattgacttcccaactccttcggctaatatgaatttttttttctttataagagtttgctatggaactgtctcgctgtttatttcaacgtttctaaagaaaatatccttttttatttatgtgaacttcactgtatacttttagtacctttcggtggatttcttctattttactcgatcacttttcttgactgtgcactgtcggtacaatccttattgtattaacttgcgaagaatatttagtcgttcagtagggttcttttggaagaaatgctagcttaacatgagtgtgatctcttctagaattaactcttttgtttatccatgtaatctgttaccaacacataaaatgcattgatagaccaaatatcaaaagcgtgcaggcatctcttatctaacagtaagcaaaattttgcctgcgctttacttcaattttccattctttttctgagtcttcgtcagtgcatatttttttactgacagcaccattaatcaatcagctcacctgcgcatttccaataatcgtgctcatgaagatcataaagaaacgtccaaacatgaaagtgctcctttagaatttctaaatccaaacgatatatgtacccctcgttgatttgtcctaaaatgagtatagcttgattttcgttatatattttttcatagtattcagaagaggagagaggatgtgatttatcaatatctgcattaagtaatgaactttgccctctactgaggatattcccactagaaaactataaaaaatgggagaaagtcaatcgctgttcaggattcaacatagttgttgacaacgtatgataagaaggccagtccagtcctcctaagttaggttaagggaggtagggaaaaactgaagtgtaatgataatcgaggatgaaagtgtgcggccagaaaaatcttttctttttatattaatctgtaataaatacaagacctatatattaaagtaaaacaacattgaatcagatcgcatactggtgtagacgtgaagtagacatatgataatcgagcagggtgctcaatttggtgtgggacacgtttgggaaggttaaaagaagaggtatatccggattacatttatttttggcgtattttaataatttactaaaagcgcgaatagcttcccattagcaacgctcagggactctttctaatgtttatagtaatactttaataagatgagtaccaattgcttctctatgaggcacaatccctaaccaaacttttatttagaattaccggtaaactccgttttcttcatagattaaatatttggctaagacaacaaaatgttctttcattttaccaaacgagaaggtgatagctgtacgccagaaaagaaggtaaaaactctcgccaatccagcaatacctgtacctctagttttcgatcgcattatgtcattatgtaaaaccaaggagagaagcaagttacggtgttttcatatagaataatttgagaattcttaataacataagatatataatcaccaccattcttatgagattcaacgttgaatggcgttgctagacatatgagctgaggaacgactattcgcattttctttcaaggcaattaattgtcttgctctgaacccttcataatgaatgtaggaagttgtttcgattaagtcttggagatgagttcgaatcaaaaattcccttaaatatacaaaatcacactggttgatatcctcaacattaatagcgctccaacgagtttttcttcccctgaaggtttcaccgtttatttcaatctcattctcagaaccaaccactgcaaacggaatgatagatctaacacttctgtttagttctaattcctcgtcagttagttcttccgaatcataaggataaatcttgaaattgtatttttcgaattcattttgaataagctccctaaactccgttctttcatctaaagtcaatgtatccgacttgccaataactggtataacatttgctatttctgtcaatcttttcaaggcttcaacgtcaaggcggctcaactcctttccatttggttgcaggaaataaagaattgcatgaactcttgtatcagtaataaacctttcacgttgggctgtcaattctttacgtaagtattgagaatgttgttccttaatgtacttcacaataggctcccaagctttagaattgtcaataaagtcaccaaatccaggtgtatctataacattaatattcaagcgaacgcggtcctccacaagagtatgagtagaaattttcatttcagttgtttttgtaacaggcagggcagaaatatcatcaccagtagcagaatcaatcaaatgtgaggcaaataacgtatttattagagtacttttacccaatccggattggccaacaaccattatattaaattgaaaacctttcttcaacagacgatgttcgatctgattcgtgatggtatcaaaaccaacataagaagcaggctgtactgagctgagaggatccattaatatatttatagagtgcttgtagtaaccgtggggcttggccttgtattttcttgtctttgcctgaaaaaagttaagtattactgatacatgtttacatatattctattcagcgattctgatctatttgtggtctctcgaggaaatctcatcgtatcatacgattatttccgcaagcattcagaaagcaaatcttaatataaggcacaatgttcccaaataataccttaacttggagacaaaaacaccagggaatatcagcaaacaaactatgaattctttgatttttggtaaacaattagcatttcacaaaattgtgcctaccactgcaattgggtggttggtaccgctaggaaatccttcactgcagattccaggccaaaaacaactgggatctatccaccgttggttgagagaaaagctacaacaagatcataaggacactgaagataaagattttttctctaataatggtattctactagcagttcctaaaaaaaaagtatcacaccaaaaaaaaaggcaaaaactttacggtccaggtaagaagcaattgaagatgattcaccatttgaataagtgcccatcatgcggccattataagagagccaatacactgtgtatgtattgtgttggacaaataagtcatatatggaaaacgcataccgctaaagaagaaattaagccgagacaagaggaggaactttccgaactagaccaaagagtcctatatcctggtagaagagataccaaatataccaaggatttgaaagataaagataactatttggaacgtcgcgttcggactttaaaaaaggactaggctcatctttcatctagtggtttcctttttaaataaacttaagcctgtatatagaaacttaatttcaaactgtatatttattgtttaagacagcatcaatggtagaatacaaggagcggaaacagaaagaaaagtcgaaatagaatttttcgcttttggcttaacaaaatgaggtctttgaaatcaagagttttgcttgacaaaaaacaactatatttcaaaatattaggaaatgatattattagtacaaggacttacagaaatatacttttaatataaaaaggaaaaaataaaataaaaagagttaattctttattaattttccaacgtcctacattgatatatctgctgagatagaattaatgttagtaagaactaaatattagacgcgaactgttgtttcttacatgacagtacagcaggataataatcctttgtcctccttcttttctgcagttgtagctgctgcaggtttagtttgtctcttagccgcatcagaagtagtggtcttcttttcagtggagggcttggcttcttttgcagggaaaagttttttggcggtttcgtagaatgttttaccttgaatttcagcaattctcaattcaagtggagacgcagttcttgagccgtcaggtcctgcaagggtaccagcaccccatggagagccaccgtgtacctcttctatactggctaactcagcaaatgaattcttataacccagtggtaaaaagataattccgtgatgagctaaataagacaaacaggctttaacggtactttcttgaccacctccgtaactggaagtactaacgaatatccccgcagctttgccgttcaaagagcccttggcccataatccaccggttttatcccaaaaggcggaccattgagccggcaaattaccaaacctagttggaacaccgaacaaaaaggcgtcatattcgagcaacgttttctcagtggcaacaggaatatcttcaggtttctgaggagcgttcatcttggtgaggacttcatcaggtaaagtttcctcgaccctgtatatatcagctttaccaccagctgcctccacacctttcttaacagcttgggctaaaacgtctatgtgcccgtaggtagagtaagtaattatcgcaatctttaccattcttatagtgcttcaattgagtctgtattgttttgtttactctctttttttttattgatactaacctgacccctcttttcctttttcctcttcttgttttctttctgataaagtttacaaacttcaaataaaaatgaacgtaaaacaagtaaaaatgtaggatgttatagtatcaactagctgccggaatagtgcaaattgtatgaatcgaaataagtacgctagccaaggcagtaaggcctaatgcccttaggcaaatttattatttatattaagttccaagaaggggaagcgccttctttccccgcagtacagtattttacccggaggttcttaataagttattactaaaagggtcataacggatttattaataatgggattataaaaataatgcgtgtgtacctagttatcgcgtgatagcttccgcaattttccaaccattagtaaattttatgtaactaaaacgaggaaggaaatagtaacgttcattttcttaattataaatatcattatcatagtgtatggttaaaagaatatattattgtattaaataagtgctaaatactaaatggtcatgaggaaagaaaaatatgcagaggggtgtaaaagtaggatgtaatccaactatagtttgctttcaatgtttttgaccaattccttgtatttctcagtagaataggactttggcctttcaatggaagcaccgatggccctatcagtgatcaattgagcaagaataccaaatgcccttgaaacgccaaataaaacggtatagaaagaagattcttttagtccataatattgtaataagacaccagagtgagcatctacatttggccatggatttttagttttaccatgttcagtcaatacgccaggtgctacctcgtatattgatgaaactaacttgaataattcataatctggaaaatggtccatggcaaacttacgctgagccatataacgaggatcagttttccttagcacagcatgaccataaccgggaatgactcttcctgagtttagagtatcccataaatatttttcgatcgtatctttagagtagtcatcatttacctcttctttaagtgcaaataaccattctagtacttcttgattagcacgcccatgaagtgggccagccaacccgttcaaacctgatgcaagggacagataaggtgatgatagtgctgagcccacaagatgggatgtatgtgcagatacattaccaccttcgtgatccgaatgaatggttaaataaagtctcatcaagtccacgaaatcttcatccttagaaccaatcaagttgaccagatttttagcataatcggcatttgggtccacttcacccattttgccatctttgaatacattacgataaattttagctgcaataactggcaatttacccagcaagtctagtgaatcttcaaaagtataactccaataatcttgcttggaaattccttgagcataagccttagcaaactttgactcgctttccaaggcagttacagcaatagagaattgagccattgggtgtaagtcctttggtaaattatccaaaagttgaacgacatgactaggtagttccgatcttgacattagatcagctgataagttttcaacttgcgcttgagttggaacctcgccagttagcaataaccaaaagagagcttctggtagtggttgtgagcttccttttgccttgggcaggtccttttgaatgtcggcgatcgtacgacctctgaaacgaataccgtcttctgggtccaaaacggaaccttcccatacgctccctggaatacctctcataccaccatatacctgttctaatagaacatcgctaattttagttttgccatgctctttaacgaattgccttacatcttgagcatggatggggtagatttcgctaaatctctcttttagagtcttttcttggcttgaatttgattgtaaatatgatgcaacatttctgtttgaatttagataaggaactgtcatttttcttgttactagtattattaaaacaaaaagttttgagaacctgttatgatatgtgttgatattgttccctgaaacttaataatgaggaacgaacaccatatctaaagaaccaagttttaatagtcttatatacgctcaacgtcgagaataatgggcccttttgagagcatgactatctttagattaacgtcaccaatttcatacgaatgtaacgctcaaaaggtaattgcgcttaccattgttattgtttttccgctgtgcctcccattgctgacgccctgatagacgtctagctacggaaaaggtcacactttttttctgcaagaaaaaataggtcgtgacctcttcgcccctagtcgatgaccaccggataaatgcgtcgaatgtgcgcgctattagtttgcgctcttttgagataccgccaagccattgattgaatgacccaaggacggatttgttcaacactccaaagcggcttatgttgtggcaacaactctggggaaagtcagcgcaatgttttcccctaaggattcgcgcgagccgtgtgtaacaaagttccgccggtatagcatatctaaaccacagaaggacgcttatacggccgtcttccacagtaattagaaggacattagtcggagtgtaaataagacggttgcatacgcgtatgaacatgggccattcattttacggaaatggcaacacattttcttgtttttaatgtaaatagtacggagttcctttttggtgcgctgaatgtatgccgtagtttggtttcttgccaggcgtgagaagagaggtcacacatgctgttggggttcatgattttcagccttcgctctgctaagtaaaaggtccattgatccgaagcgcttcctccaatatcgcagtgataaacggtcatgtaagcctacagtctttaaactgtagatgatttaatggattatctcatacattgaatatcacacttcagcagttcaagttttcattaacattggtcttctccagcttactctgtaaagtccgctgcagttttctagaaatcataatctgtacctccattcagccatctgaggaacctccgaaataacgagtaaatgttcaaacatgccatgcgccttggtttattgtacgagttttagcatattgcaaaaaaaaactgctcctgagtacacttgttttacgtcggaaagataaatgccgtaccatttctgccagtagcgacaccacacattgtaaaaacaatgtggggcgagccgggactcgaacccgggacctcccgcaccctaagcgagaatcatacctctagaccacacgccctcctttgaaaaatcccggcagaacagcgcctgaagtctgggatacagccctattttccctgccatcgtcattgacctttttcttaacgaccagattaacagccagttattgaaagtttgcgaacgtgaagtaaaactgcaaaatggtcgttttaagtcaaaagtaaccctgcgtcacacatgagaaacattatcgctaagttgttgttactacttcttgtaattaacttactgtcgcattccaaatggactgcgaaacagacacgaaacaattacgaaagtgacgacagagtaaatattgtcattaaagagaatgatgacctccgggtaaactgtgagaataagtctagaccattcgttaaacttcatctttaattgagaagcatagtaaaaaataattaacaagttaacacaactatcttgacccatgctaccaaggacataagtaatatcctccaccacttttactcaaagtatatctcattctgagaaatgggtgaatgttgagataattgttgggattccattgttgataaaggctataatattaggtatacagaatatactagaagttctcctcgagggtctaggaatccccataatggaatctatatttctatataccaatattacgattattcctcattccgttttatatgtttcattatcctattacattatcaatccttacacttcagcttcctctaacttcgatgacagcttctcataacttatgtcatcatcttaacaccgtatatgataatatattgataatataactattagttgatagacgatagtggatttttattccaacacattcgagctagtataaaattgtgaggaattatcgggcatcttgtttattaggtacgcaaattgtaataattgccaagttgtgctttttagttgagaagtattccgtcctcatgaaatggctaatataagtatggatttcataaatattatccaaagtaattatacacacttgttttttgctatgtcttgggtttaagagaaaatgctacatagaccgtaagaacgtcttcaagaatgcaaggatgctgcaagcgaagttgttcccgttatgaagcagaaagggcacatcaacatggttcaaagatttaaatttcggcacttgttcttgttcactatatgttttaagattcttatcgtgcaagtattcaattatatcctctaagtgaccgaacaatcaacacatcaagatttttgtagttttgaagttccacaacctacaggttagtgctatttggtctaatttatacatgggaactatgtgaaacagtaatgttagcacaatggacctctcaaagcctaagaaaattttgctggggacaaaaagtggttcttgatggtaaagaagtagtttagcttcataataatttctttgtaaaatttttctcgtagcacactaagctttcagaaatcaaataaggcagaggaagtggttttgtcgtattcaatgactaattgtaagactcgagtataacttatgcagtttccaagaagtaagcaaacagtttctctcaacctttggtgacacactatgcgcatgcaagtcgtaatgcttctctatttatgtgtgggtttattaaaatagttagaattatctaggtttgtgggaatttggccatgaatattgaatagtaacaagaacaaagcgtgaaaatgttgaatataatgaaagctgaagacatcaaatcatgttctccaaatctttctgtctcgtatattttctttgatatttgttttatgcggaaattgcagtggaaacaatcgcgaaacattcgagaaagaaactaggtagctacaaaagtatggaaaaaagggtaataagcattcctttttttttagccgcaaagcctgcttaaccatacatgaagcactttaacatatagatgctgctcttcactgttacattatatacagaaaaaagtgctcgcaataagaaacaaaccttcagaaaaagaagcttatcttgagcacaagtcattcacagcaaaatttcttttttcagttgctacatgttaattatggagtcctgagagtaagtaactagccattagaattaatttccttcccttaaaaatgatagggaatgcacgacaatacgttaatgtgcacccaacttgcaccacagcatattctatcctttagtttgtacaatattattagctgtgagaaagccccttcgtgtggcacaaatttattaatctctgtcaaaatacttctacttgtttatactgtataaacgattaagttccattatgaattgtgaatttagaatcggtttggtacatcgctcagtataagtgctaaataaaattatcaagatttatatttcatggtatatcggcgtcaggatattgctttctccaatattcctgttgtgcttgtttctcaacttctactgctttaacaaagtatgcttcgaatattgggtcagaactgaaactaaagcattttattacctcatttgaagcctcatttgctggtgcatctatctgcgtacttgtggcgtcctttaccgatgaatttacattcacacctgggggtttttctttcacaagaaatctgaagaatttgtagcatctttcactactataaaagtaatagcgagtactccataaaccattatcaagtaaatattgattcatattgtctgtgattgctctccattcttttccctttaccgctggcctgtgggtgataacttccagcaaaagcttaattctgaaaccctcatccgagatatacacattaaacggaatcaacgtagacaaaaacaaaatagaagtgacgaaaattgaaaaaccaaaaacgacatcacaagctttaacattatgaaagatcacaactattaaaattgaaactgaaagtgccaagaaggaaaatatcatcggtttgtaatgagccatctcgtacagcaagtaggtcatatatgatttaaaggtgtcttcaggtaaagtgatattttctgcggatgataacacattttgttcccctaatgtatccaatttgacatcgtcattattactgttgttgtctaaatgaggctgcatgcagatacggagttttgtttcttgtcttgatatggtatagacaaccgactggtgtatataaacagaacacagacttacattttcaggttcgaagttttattgaagttcataaactctttttaaattattttgtaaacttgagctattcaagcagtattcttatttaacctaagcatagccccggatacaaggcgtataatacccaactaacttaaaatgagagccacttactgaacaccttggaaggtcattgtttggttgaaaggaatattattaactaagccttagaacaaggcgtcacctaaatgataatggcttttcttctgggcgcggtcggggcttcgactcatttgatactaggttaattacccttttacgcatacctaaatatttgtaactttagatctgtccactaaaagcgtttcgatgacttagttgtgctactaatagtaaactctttgtgcaggcaaattatatcatcgctggctagactttttgtcaaaagttctgtttatacagtgggcagctagagtgcttaataacaaagatattgtcctttagacttacacaagagcagaagcaaagataagcactgtttgttctgcttccatcgtttttgctgaaaattttgcatgcatatccaaccaatatttaacacctggattatctcggttcaaagactacaataaacgccccaataattgtgatgcttttttcaatccagcccgcacaaatgaataccgctgctattggatgccatcttcagatgtacgtccaaactgtggttggtatagtttttagaacctcgtggtgaggagtgttccattctttcaaaggcaatgagaaaaaaaaacagttgcgatattagtcaactgttttgcatggtttctttgacgcagttgtaaaatcatactcgaagggtagttggaaaattttcaacatatattagtaatactttttctgtaaaagtgacacaagataaaatgactccatggccaagttggttaaggcgtgcgactgttaatcgcaagatcgtgagttcaaccctcactggggtcgttaatttttcttttctttttttttttttatctccgacggagaaaaaattttttctcaacccccggcatggcgaatggaaaaatcacctggcacgtcatttcatcaaatcaacatcggcctccccgtgctaatatgttaacaggccgagctcttgccatctcacgcattttccgctatacaaatagtatatataatattacagcttttaaagagggaagaggaaacggagaagaaaatatactactttatagagatattcggcaattttttttagcaaaagtttattaaaccctaatatagacctttacttggagtttcgattttaagaattttttatcattttttttttttgacgatttctgtcggtttcgttataacctgttgtgttgttgttgttgttgttattgctgggttgttgttattcactttaacattatcgaataaaatttggactttcaaagtcctgttcaataagttgtactaagcctttaagcgtttttaagttacaaataaaaactggaaagcttaaggtagctttctaatattaggctctcaacctttttttactctccatttaccgctagatattaactagtagtaagtattgtgactactattccctgtaatcaaaaaaaaagtaatcagattttattttatttcgacattacccctcaaatatatgactggtatgaatgataataatgccgctattcctcagcaaactccaaggaaacatgcgctatcttctaaagttatgcaactttttagaagcggttcaagatcatctaggcagggaaaggcctcatcgaatatccagccaccttctaatataaacacaaacgttccatcggcgtctaaatcagccaaatttggtttacataccccaaccactgctactcctagggtagtttctaatccttctaatactgcaggtgtgagtaaaccgggcatgtatatgcccgaatattaccagtcggcatcaccatcgcactctagttcatccgcatcattaaacaaccatattgatattaacacctctaagtcatcatcagctgcttctttaacttcgtcagtatcagctttatccttatcacccacatcagccataaatattagctccaaaagtttgagcccaaagttctctcatcatagtaacagcaatactgctattacacccgcgcctactcccactgcttcaaatattaataatgtaaataagataaccaatacaagtgcacctatttgtgggaggtttcttgtgcataaagatggtacccatgaacatcacttaaaaaatgctaagagacaagaaaagctaagcacaatgattaaaaacatggttggtgcgagcaaattacgtggtgaggcaaaatctgctgtccctgatataataatggatccaaagacgactttaaaatccaacaagaatcctcctactctttttgcaggcttcatgaagcaggtcgtggatatggatgataaatatccagaaggcgctcccacaagtggcgctttaaattgtcctgaaagggatatatacaggtcagatcaaaaagattccaaaaataatacgcataatatcactactactaaaaaagataggcaatgttttgccgaaaagtatggtcgctgtcaagaagtccttggtaaaggtgcttttggtgtagtaagaatatgtcaaaagaaaaatgtttcttctcaagatggtaataaaagtgaaaagctttatgcagtgaaagagttcaagcgtagaacatccgaatcagcagaaaagtattctaagaggttgacttctgaattttgcatttcttcttcattacaccatacaaatattgttactacactagatcttttccaagatgccaaaggcgagtactgtgaagtaatggaatattgtgcaggtggcgatctattcactttggtcgttgccgccggaaaattagaatatatggaagcagattgtttcttcaagcagcttattagaggtgttgtttatatgcatgaaatgggtgtttgtcatagagatttgaagcctgagaacttactgcttacgcacgatggtgtgctaaaaattacagactttggtaacagcgaatgtttcaagatggcatgggaaaaaaatattcaccttagtggaggcgtttgcggttcatcgccgtacatcgccccagaggaatatatcaaagaagagtttgatccaagacccgtagatatatgggcatgtggtgtcatttatatggcaatgagaactggtagacaattgtggagttctgctgaaaaagacgatccattttatatgaattatttaaaaggacgtaaggaaaagggaggctatgagccaatcgaaagtttaaaaagagccaggtgtaggaatgttatatattcgatgttagatcccgttccgtacagaagaattaacgggaaacaaattttgaacagtgaatggggaagggagataaaatgctgccataatgggcgcgcattgaaataaacgagtacttcactttcaaatatcacgatattttggaacaattcggtattttttacttaatctagtacactaaggaatgctttgttatccggcattcgtatcttattcctcgcttctattgttctacttttatatcccgtttggctgattacggatcacgttcaaattggtaaatcccattaattaaaaaagaattgtaaccttatttaaaaaaaaaaatagtacataacaataaaaaaaaaaaagataataattttgaatttattgctagacattcttacgtttattgtgttcatgttaacaaaaacacatgcccgcggttattatcgctttttaattgctttcttaaaaagagtcggttggtcagatagagcagatagtaaattatagtgctatttaggtctgttaatttaaatgaaagaaacataaatgaccgtaaaaaactaaaggcaaaagcattaatttattttatcccgagcgcacaaatatctaggcttgtcatttgtcctaatagttcttcgattttagtgtctaataacccattggcatagtcgtctcttgattgttggtccaaatattgttgaatctgcgctaaacgagtgtaaccatcagtacagaaccttagctgaatcttgattaaagcttcaaaacttgggtcaaagtaaggtactcttaatgaaactaactgtggtagttcagttttcaattggttattaagattttcgaaaatatctttagctaagctcaattctttttcagcccttggcagtttagaggcatctttagcaggtttgtccactaatctacgaacttttgccttcgcagcatcgaagtcttgtttcttatggtctctcttttttatggcctcctcaatttctttgaaatacgtcgaaaactttgttattggatctagtacggtttctcttaagggcccgtctaattgcttaacagtttcgctatcaaaatcttgaacacattgcaaataatagttaccaacgttgtaaccaccaccagcaacatattttgaatcgtcatagaggttagagatgacctcggcaatggtagtctgtgatgctgtcacagctctcaatgagtccaagaaacctttggcttccttttgtaatgcctcacctgctctttgaagaactttataacgacgttcttccatgtcatactctttatcaatggtcttgtcgacattcttaattatcacactgtgaccagctctgttgatagctttcttaaaaccttcccaactcatcttgtatcagctttcttctggcttcttataataggatttgtatagttttctatatcacagcgtttccttttcttctctcacgtctgcctgttattaaatttgttttccctttcttttaattcggattctcataattgttcaaaatccgcgcatttggatcgtccagcccctgcagcgcccagttcagccaacaaaaattcatagggacgtaaaggaaacgtttcatgtctgttacaatgaaaaagacaagtcgaatcacattatgaatggcaaacgatagacctttcgttgcctttcaattacatgatattcgtggcaacatcttctccgctaacctaaaagttttatcagaaacatatatcttattttttctgaagtaaaatcaaagtgcagggaagacaagtaaaggagtcagcaaaaaagtgaagtaaacttatatgttaactgtttataaccgtaccttgcttacatcatctatattttcgtaatcatttttgtacattgtttatatcttgttttgaagttttagctttgaaaaacatttaattgcgaagtaacataatgttattaatagtgtacgactgaaacagccattctatttaaacatataaaagtacgattagttggtgtggttatataagtcataaaataattatcatattaaaaaattgaaaaataaaaaactactcttttttatttcaatagttctcgttattagtaggtcgtgctcttaaaagattaccctttcagtagatggtaatgggaatggacgagccagtacatatgaattctgctttgtagcaacacctgcatatgcgttgtaccaagcaatgaaagcaacaacaactcccaggacaccaccagctcttgtgacaccaagtctattagcaaagtgaccaatagacaacagtaggaaagttaatgctagtaagaagaacaacaaaaagaacataacagtggatttcatggtacaaacggttaaaccaaacgtaaagatggcccaccccaacaaataaaatcctaaagcattattcaaatcagattcattgtcttcgtaagcttccaagataccaaaccaaggaatgtaaattgcagcgaaactcaaccaaaacccaccgtaagaacataatgcggtaccaccaaaagtattttccaaagctatctcccaaataccagcaatcaattgcaccaaaccaccataaaacatagcacaaccgacgacaacattaggaacagtgatcccttgcgctctcgcattgaacatggacagcacaaatgtcgtcaacgcgaaggctgaaagacctaagggcgcaggattagcaaatttgtgcactggagcaggagctaaccctggattcaaggtaccaccaaaggcttggtataagtcgctcttcaaaaacttttgacgcccaatatagatatattcattgttatcacctccagtgtaaatcttgcccaacgaatcatgagatggacgttcatcttctgcaacgccattaacgtcgttatcatgggaactatagtatcctgctggtgcattctccaaatctgtgtttccgctcgtttgttccttgtcagacatattatttgtttgtatatgagttgttttgtggttgtttagttatatctgtgttagctgtcgactatttgcctttttcttataaacagatgctagtagtttctgttgtattgttattgctattggacgatatataaaatgaacctatagcaagatctcagggaaatacgatccaaccaaggtgctttatatacagcttggtgtctctgacaggttggagtacagaggagaagcgccatagccgcccaacccgcgataacgaaaaaaagctgtaagaaaatgcagtcttccccaacgtttgttaccccaacaataccgaaatagccgcccaaccgcaaatctggcaaaaaatcttttcgtatctcgctgcagatgaccttccaacccgcccctttttgtagtcacgcctttaagggcccttgtttggcttgctcacatggggctacacgtaaaaaccgtagcttggagaaccactcagccgctcgcctattccacggagctccggatcaacgggcagtggaccctctcgaaaataaggaaagttgcggggccaaaaattattatttcttatgtaaaagaagagactatatacgacgcctatctacttttgttccacaactatccacttaagggctagataccccattattaaaaacaccacattaaacagagccaggatcttgatgtcaaatacaaggttttggacaacaaatccaaatgtgctcaagatagtagcgcctggaacttcaatatttaagccgtactttctctctttcagcatcaatgttttgacctcattgatcaataaagattcgtaggcgtagtaaaacacagagaagtttttcaggtacttgaaggccacgtttgtaatattcttagtattgataaatagtccgctaaacagtagtgagcccaaaagcaccagcacgcttaatattatggagttattcaagtcttcaaaaattatgccgatggttaggatttccaacgatatcccaaggttaaacagtataaggattccaatacatttaaaaaaagcattgtctttcatgtttaaaccagtcattgggtaaacaatcaatgacaagagtataggtggtacaacacgtagcgggaccacttcgctcattatcttactaatgtagtatgcaagtggcgagtaatagttattggatctttcttttatgaaaatgatcctttccagagcgaacgagctgagacctgtgaatgtaacaaaaccgaagtacgttagtataaagaagaacagccccattctgttctgaaaaccgctgatatcattggagacgttgtaatatagtgttcccaagaataaactcaataggatcgtcagtaaataattacccaataatagtttagggtttctgtacatgtttttaaaacttcttgaattcaatatcgataactgttgcagaaaaccagcagattgttgacctgtgggtaaatctccattcaaaacgttactttcctcatcaccttcgcttaaaacttcctcgatctcctgtgaaagctctgcataatagacgctatctttatatttatcgtgtagtagtttggtatttaagtcaatctcagtagcacctcgccttccatctgttccctctacatcttcttcatctctgagtaaagatctgatctcatctctatgagctgcaagatgagcccactctctctgtgttgtaccatcactgctagtaaatgttgtttggtgtatcgtattatcaatatcgttagtatccgtaccagcttctaaatcggaaatgtttctgattcttctccttttcccctgaggaccggcttcaaaagtaatatcaatcaaataatcagcaatattatagttgtccggacagatatatccctcatttctcaaaaattctgacacttttttggcatttccggaatagaccatctcacctttacttaacaggaccaatttatcgaataaataaaatatatttgatcttggctgatgaatagatagcaccaatgtcctgttatagtcgctggataaccttaccaaacattcaataacattattggcattactagcatctaaaccagatgtaggttcatccaaaaataaaaccaatggagatgtcactaattcacatgcaatggaaactcggcgtttttcacctccactaataccacgatcaaattcattaccaataatacgatctttgatatcaataattcttagttcttccaacaccttataaactcttgccttcttggcctcgaatgacaatgcttttggcaatcttaacagcgcactatttaatacggtttcaaaaacagtcaaagtgggcagcaaaaagtcatcttgatcgacgaacccgattattttcgagaaagatttacggtccatactaataccgttaacttttatggaacccgaaacgtgacctgttttccgtttcattgctaggatatctaataaagtagttttacccgcaccagatccacccatgatagctaatatttggccgggcttcacgataccacttatttcattcagcacagtttcttcaacaccatctgaatttatcgaggggacactataagtgatattttcaaaacttaatgtcgccagtgtgtcatcttcattttgtaagaaattattcaccgcatcttcatctggcaaacgaatgggagactttgaggaacccaatccatttctgaataacggagatttagaaatgtaaaaggtagcaaatgtaaaaagtgccaggaccatcacagcagtcaatgccaacaccaatttcccttgccatgacactgttggatcttttgaaggagatttgtaacctggaatctcactataatgaacacattcaccggattcacacttcaaagtaatataagggtcaccaaacacggtcaatatcaaatcattcatagaaggctcactgaatttacattgccttgtttctaaatcacagctgaaatctcctggcccttttattgtctctgtcaggaaatccgagatatctatagaccccttagcaccacacaacacagtgtcgggaacgcatttgcattgaacgtcattacacttataatgggaggtattctgttccaagtcgtattcaaaggcacaatcacttaagccacaatagaagctttctaactgatctatccaaaactgaaaattacattcttgattaggtttatcacaggcaaatgtaatttgtggtattttgccgttcaaaatctgtagaattttctcattggtcacattacaacctgaaaatactttatctacaatcataccattcttataacatgtccccttaatactaggatcaggcatgaacgcatcacagacaaaatcttcttgacaaacgtcacaattgatccctccccatccgttatcacaatgacaggtgtcattttgtgctcttatgggacgatccttattaccgctttcatccggtgatagaccgccacagaggggcagagagcaatcatcacctgcaaacccttctatacactcacatctaccagtgtacgaattgcattcagaaaactgtttgcattcaaaaataggtagcatacaattaaaacatggcgggcacgtatcattgcccttatcttgtgcagttagacgcgaatttttcgaagaagtaccttcaaagaatggggtctcatcttgttttgcaagtaccactgagcaggataataatagaaatgataatatactatagtagagataacgtcgatgacttcccatactgtaattgcttttagttgtgtatttttagtgtgcaagtttctgtaaatcgattaatttttttttctttcctctttttattaaccttaatttttattttagattcctgacttcaactcaagacgcacagatattataacatctgcacaataggcatttgcaagaattactcgtgagtaaggaaagagtgaggaactatcgcatacctgcatttaaagatgccgatttgggcgcgaatcctttattttggcttcaccctcatactattatcagggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaacaatgtctttatcttcaaagttgtctgtccaagatttggacttgaaggacaagcgtgtcttcatcagagttgacttcaacgtcccattggacggtaagaagatcacttctaaccaaagaattgttgctgctttgccaaccatcaagtacgttttggaacaccacccaagatacgttgtcttggcttctcacttgggtagaccaaacggtgaaagaaacgaaaaatactctttggctccagttgctaaggaattgcaatcattgttgggtaaggatgtcaccttcttgaacgactgtgtgcgtccagaagttgaagccgctgtcaaggcttctgccccaggttccgttattttgttggaaaacttgcgttaccacatcgaagaagaaggttccagaaaggtcgatggtcaaaaggtcaaggcttccaaggaagatgttcaaaagttcagacacgaattgagctctttggctgatgtttacatcaacgatgccttcggtaccgctcacagagctcactcttctatggtcggtttcgacttgccacaacgtgctgccggtttcttgttggaaaaggaattgaagtacttcggtaaggctttggagaacccaaccagaccattcttggccatcttaggtggtgccaaggttgctgacaagattcaattgattgacaacttgttggacaaggtcgactctatcatcattggtggtggtatggctttcaccttcaagaaggttttggaaaacactgaaatcggtgactccatcttcgacaaggctggtgctgaaatcgttccaaagttgatggaaaaggccaaggccaagggtgtcgaagtcgtcttgccagtcgacttcatcattgctgatgctttctctgctgatgccaacaccaagactgtcactgacaaggaaggtattccagctggctggcaagggttggacaatggtccagaatctagaaagttgtttgctgctactgttgcaaaggctaagaccattgtctggaacggtccaccaggtgttttcgaattcgaaaagttcgctgctggtactaaggctttgttagacgaagttgtcaagagctctgctgctggtaacaccgtcatcattggtggtggtgacactgccactgtcgctaagaagtacggtgtcactgacaagatctcccatgtctctactggtggtggtgcttctttggaattattggaaggtaaggaattgccaggtgttgctttcttatccgaaaagaaataaattgaattgaattgaaatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaaaaagtctaatcttctgcaataatttccatccttggcattcagagacatatattggtcaatcgggtttaattttgtttcttcttcttcttcttcttcaattaacaatgtgccttcatcatttttcatttctttcagttcttctaattctcttggagagaatttgactcccatgaaaaatttcttgattatctcagaagaataccacctctttctttctccatacccaacaatcttcgctgtacgaaatctctccactattctttttaagaatagcttttccaagtttggcgttagctgtaaaaaacaatggatatagccatccttgtacaacttaatacaaagcgtttccatgatttttgccaactcggtcgtgtcattacaaaacggcttgaaaaataaaagatcaatgtcaccacacttggaatagcccctattataacttccctgtaattcgacttggcattcaggatcaatgccacgcagcgctttttgaaccttctttaaatgtgtgaaacattcattccgagacatcttgcataaccaatcgtcgtaatatgaccaaccaaataaaattgtccaatctgatacaaactcctctggatccttcttagctgcaacacaaaagctttcaaaatttagaagattccagcgtttagcaatttccgacccaatgccgtaacaatttttgaagtattttaacttgtcttctaatcccactgaatcatttaaacctggtaaaactcccgtatctaatataacttgtatttttttggcaatactaggcccgatattccttaatttagtatgtgcttcttcaccggaacgaacattgaaatcgcaattttccatcgactgtttagccagtctataacttcttgcacgaaatttctcaccttcgatctcatatttttttgttaaccttttcaacgctccgataatcaattcattgtttttgtacttcgttttgtcagtaacaagggaagctcttcctttatcctcctgtaaaagtcgcttaagaggttttgaagcttgtatcatatccttattgttgctgtcatcattcctttcactttctacgtcagttgaaatctcactctctttatcagtagaactttgtccgtcatcagcgttatctgatataacgataatggatggttgaaatttaatcaaatcatctttttgaaacgcaaatttatcattctggacccactttgtgatgcaactggttttcacacattgaatgcctgactgttcaatcttaccaagaaattcatcgacatcatttaagcctgcttccctttggaaaatatctttctgagtcaaatgcatatcagaatcaacaaaggagtcctcaatcaaaatgataacttccttacggctagattgaagacaattttgaatacttgacacaattgtggcgccctttttctccaatatactcttaaagaacttattggaagatgtgttaggattaggtaaaaaggcgaaaaatttaccctttagagacatgtgcgatttgtctaacaggtcgcatgtttatcctttacttattaccactgtgacatataagttctttgcaagcccttaaaattattagccccatgtatttgaacatctcaaagtaattttagaccgagaccgattacggagatagaagaatagtgcaagcgaaatactattttatctttacttaaaaaagaaaaaacaggaggaaaattagcggtattccattattattagcactgcaacgtcctggttatataaatttgaatatacaggatttcatccgtttctacatttttgttacctgcatgatcaaatcttttaaagagtcccaggatttcacaaggtaggcacctttaccgccttccttttcacaaaactgtaaccacgctggaccattatcagcttcaaaactcgagattttatcctttgggataccaataatcttttcggtaatttttatgaatttggaaggattttcttgcgggtttattagcagtacaccattagtagatggatgtaatatggacaacaagtcagtctcactatcccctatataccagtagctgcaagaatttccttctttattgcaacctgagtcgatcttatctaatatttcacccagtatcttgaccttatcagagcctgtcaataaccgacaatcaaattcaccattgtagctttgagaacacttgtcactaactttttttagatcgttacaaaaaatatgactatttttaagtcttctgtcaccaatgacttcatgaataaactcttttgaccaatttatagataaaacgtaaaaatcactttcaaaatttttgacaactgaagagcaaaacgttttgaaaccatctcttagtaaacaatcatcgtgattctgatctctggcgaacgttttcatttgatccaaagaaatcgacttaaaaatctgttgttttgtaatttcatttacactatttaactcaacaaccctgttatgattttgatattttaattcgtccgcaaacaacttattgaagttagactgcgaaattatcgtaggtacgcctgaagataacaacggcagtgatctcgttccattgtatttgtatttatggtatccgtccatatatgtcttggtaaaatgaccccactcaggtttcaaccgcgggttcagtagatacggtaatttagcaatggtgcagattgtgtcaactcttgtgattgtttcatcaaaatctgaaataataatggttttcatatcctccactgttcgcttctggttactgcaattgttaaatgcattggctcgattgtcaacattgctttgtgcgaagaaaggtcgcttttaaagaaaacgataagaactaacctctaactacataataataagaaaaaagtatacagataaacaagctcagtagtaatacataaaataaaaagttttgcaaatcgattgtccacacacttctatatcaattccaactaagaaaacgaaggaaccgactcaaaccggtgtaaaagctaggctttcaatctctgctcctccaaacaaaactagtgcttgatatcacatccaattaaattacctaaataattttagagtgacaccatcgtacaaagagggcattaagcttattttttttaattcttatgaaaaaaaaatgtggaagagagcagaaaattttcataatgaatctcttctattcttatgtaccgttccgccaaatttttcatgaaaaaatttgggaaaaagaaaaaaaaaaaaaaaactagtatataaagtaaaaaaagatgcgcaagcccggaatcgaaccgggggcccaacgatggcaacgttggattttaccactaaaccacttgcgctagtaatattgatgcattattcaagaaaagcaaaaaacatattagccgataatttctattttataagtaaaaacattggtgagatagtggtaaagagttagataattattgggattccattgttgagaaaagcaataatattatgtatacggaatatactaggagttctcttcaaggatagaggaatcctcaaaatggaatccatatttctacatactaatattacgattatcccttcttctattttatatgtttcattatcctattacattatcaatccttgcacttcagcttcctctaacttcgatgacagcttctcataacttatgtcatcatcttaacaccgtatatgataatatattgataatataactattagttgatagacgatagtggatttctattccaacaagaacatccttgaaaggtcgactattaacataagaataagagagagtgtgtggccgatgctgttgctatagctcggtcgtagtttaacaccacggcattattcagctttaaaacaattgaattataaacctgcttttcttactacgaaaagtgtttccctttaataaatctattgtacatactttacagttgatagtaccttcaccataaaaatatgcaaacgcttttgttattgagaacaggaataccaaccgttctcatggaaaatagcaaagtgtaaaagaatttattatcatcgagtgataaagaatatcgccagatctttacggatatatatcgctaaaaatatttgtcgccaataaaagatatgtctaacgctccctttgcaggtagttttttactggcatcgcctttttactgcaaattattgaaaattttcgagcgagaaaaaggaacgaaaagagatgagctaaattcaaatatcaaagtactgtggtaagtgctttctttatcgacaaattacaagcagaagaaacattcactttacaattaaatgtccgaaaatcacgttcctgcctggaaaagaattgctttgaagagacagactataagcagtggtgacgaaagtaaagaaaaaggccaatccaatctaatagatgatgatccactaaatatcactacgcatttatccactggtaatttgacaaagaaagagaaaaaaagaatcattaatggtgagagcaaatcctctaccaaaaaaggaaagcgtgtgtcgaaaccagggacgaagaagaaggaaaaattgtcaaaggatgaaaagaattcgaaaaaaaataaaattcttaaagatcaattacgttacctgatagaatttttcaggacaaagtctgagagcaagtttcccaccggaatcctagaattggaaagtgtaaaagaaaattacggcgactccctgatcaaagacgagccatcagagtctggtgttgttgaagtttggaaattttccaagcaaaagcaaaattggcttattaagcattttttcaatttggacgaaatcccctcagtatataatgatcttttgcttttatatttcagggacttacaaggtaaatcaaaagaagaactaatatcaaaatgcaaaggaaaactgaagcaatggaacgactatgtggaagatcaagaaacaagaataaaagcgttaattgcagaggataaggctagcgaaccaattaatggtgaagaaaaagaagaaggtgaaaaagacggtaatgccgaacaagggaagcaaaaagaggtacaagacgagcaagaggaagtacaaatgccgaataaagagcttgttcaaagaagtttgaaattactagaaatttggaagaatgatgactcggagcagatagaacttaagaatttcttcgttgatgtttaacatagagttcaacaacgttgttcagttgtagtatatattttgctgtgaaatacgctcaaaaagtagcgggataaatcgtttcaggaagtataatttcttacaaaactataacaagatcgtctaagtaacatacataaagaaatcacataaatttttaaaattcgaggtcaaaaaaatcaggtggatacataacttaccttaagttatcgagattttcagtacacacaatgtgattacactgatttataaaaccaccttacggcctcttataagtaataacgtggctcatcaaaaacatggtagaagtgacccctctcaccttcgcctaaaaacttatctggaaatttcatgtcctcatattccggttcactcatatgaccgtattcatacatagaatccgagtgctctactaacgcttgctcactcaaaacttggaacttaccaacttgtagctccgtatcggttatcgttcctcttgcaactctagcatatcctgttcttctcaagcccttatacaagatatactcacaccatctatcatcgtcagagggatcaatgtcgtgcattccggatgtttcactaacgtacgtattgtagttgccttcacctggatcaacaactaagtaacttaataaaatagctgggcgagtcgtattgcccatgagcttagccatgtagttactttgcagtcttctatcctcttcatcctcttcttgtccactatggaatacaaagacgtcaacgagagtgtcattgtacgtttgaagtgtggcatgaatggctggcgcaagttccccaactggagagggcaataaatgatgcgtagaatttacgatagggaatttagaaagaagaacacagccccaggtatgtttatttggacctggtccgaaatctgcatacatattcaaatcatgagctagtttgctagttagatccctgttccccatggtaattctttgtgtatctgtttctagtagacctaccacatctagttccatatctttaataaggttgatcattctgtcttcagatgcccacatatcattatcgagaccaaagtggatagtccaaataccagctgtaatcaactgagaatctggatgataaggctgaggaattcctgtaggtctaatatcatacacgaacctagctgttagtgatagtagggccacggcaaagaagaaaacataaatgaagaattttttgcccatagtcaccagttgaacgttaaggtttttgcatgttaaagcaccaataatgataaatgtggaagaaaaggcaagaaccgtctcaatcttctccctcagtacccagcccattggaacaaatgcgtatgcaacgacccaaacatgggcaaggacaaagataatataaacggagaatgataggacataaacccatatgttttgaacttggcctaatgcagaaaaatacgaaggaactaaccaaagcatagcgatagcgtacaataaaccaccaaaaatatatttaggccattgtgtaatgcttctagctgaaagtacagcagtggatatgagaagcaacaaacatggaactaatggcttgcccataaacttcacagaactcaaagaagcaaataacatgaccgtacaagttaaggcgccccaaggccatggcaagggaccgtgtgattcattgtaaccttcccatgcccaataaatagtagtagaagaatccgtcaataactgatgaattccgaataacaacgagccaaaaccaacagccaaaaataatttgccgatcaacgaagcagattttgcttgagcattccttttcccttcgaaattaattgaattaacataaggcgacagcatgccgaataaaacagtaagcacgagagctgtcttattatacccaccattacgttcatctaaaatgacccaagttgggttgttggtatagaaccccattttcaagatcacagatgcaacaagacctagcagccaagttagagcaaaagagaaactagtctccgcatttgtgatatatcttagattttgtacaaacgttgcaacggtaatggaagttcccacagctacagaaatcaaccttaattctggcatctgaacaatataggcaccaatggcaataatacctcctaaaagtacaccatattgcatgaaggcttcagaaacgaacggcagatataagaaaatgggtcccaaataacccaatattgcagcttcataacctgagattcccatataccatagcgggaaatgccaaatactacataaaagggacgtaacgttcgaccagaaaagaaaaccgttaaaaatatttgttagtaagtaaaaaaaagagtcaaacctgaaatatgaaccagttgcgcttctagcaacgggtttttccttttcaaccttcttttcaccacttttctgcaattctgaacttttttcttctccataatttatgggattagagtctctaatttggaaaaaactggtattaccgggtttctcattaaaagcgagaacaatatctatctttttgaaatcagcgtaagcaaatgcatcaaatgcaatatctaaaagaatcagagaccattcgaaataagcatatatagaatatgccccagctctctgttggacggagtgctgaatgtaccagtaaatcatcgggaacaatgttccaaaaaaaattgtagcagtcaaccctttgttcttcgaagttaaaggactagaatagcgggtaatcattatatcccatggtaacgttaaaacaatgtatgtgatcataaatatatcatgaatatcgtggtcatctgtacttgtaatgtatacccaaccaccgcaagagactgtccggagtacaccgacaaggaagcataccttagattggttcaagtagtagtgacctagtagcagtaaaaatcttggaaaagcagttagagctattaagatttggaaaatagaacgttccggatagcggtccccgatagtggctgatacactaggaaaccactcatctggatacgtataatgtgcattggttacaattttatgaaaatgtaatgaataaccagtgaccaaagctgcaaagaaggcggagaatgcgcaaatagtatgagctatagggatgatcttcccattgatgatcagcataactggcggtggataccttctgtattcctggttacttattcctcgagaaatcggacattaaaagggtgcaaatactgtggagaaattataagttaccaagtcaaaaagcgaatgagaatctattgttgcgatttttttggttactacttcttacccgaactaactttacataataaaaaagcatgaagcgcatattcagggactcaaaaatcccaaactggcacttctgtatataccgatgagcatattttgattgtaaaaaacaacattaaaaagaactgcaaacctgaaccaagaatacttaatttcaaaaccgagaaatgaggtacaacttgtagaagttcacttaaacttattgagcatacaatctcaacaaaactaactgcaaagtttgttgctatagtcacatagtaatactagcaggaagccattaatcaaaaagaaactccatataaaacgtaataaatattatgaataatagtacaatataagaacaaagaagaagaaaatacattataactgaagtgccaatattagaaaaaaaaaaggtggaatatcctagtggaaaaatatcatctatgcggtgaaagaattaaatagatactatggattgtttcgaatctatccttttatctgccgcttgcctttttttttcattctccttcttcagtctttttccataggcgagtccacagggactacaaagttccctgttttggtcgggtccactacgccattgaattgtccaagtgtctttacatttagagcattcctttatctcaccatttgggaggattgtttgtctcttttctcttttaggacgactagtagtctttttgctgtatttcttcgtaatactggcagaccgactagttccttgtgcacaactatggtagccttcaagattgtttgcttcttggctagtcgtacgtctctcggaattgcatgcactaataacacgattctttgagggtgtaatttcgttcaaagagctggttttgttcttaacaatatttcttgtaagatctcttagttgttcggcattctcaatttttttttcaacatcaacagcccttatttgagaaaaggatacttcaataaatgagcaacttgcataaactcttccgcgttccttatatgccttctttttatcgtttgacttccagtcatcaatttctctatttaataataacgttttctccatatctgactttttaactactctagttaagaaggaacttccagagttgtcataattattatatcgcatactagcaatagtaaatgtctggttatttacctagcaacctcttaacaaagcgataacaatgaaacagcaatataagtctatttaattgacaacatcattgataaaagtttgaacaagcgtctaaaagtcgaagaagttcatttcaaagttttgtgtatcgagcttgatgatacttatttagggatccgctctagtttactgtgatacaactgaaaaacattacaaagctatcgcgcctgcattctcatattagtggcgtatgtttgtgtcacattcgatacttctacataatacaatgactgaacccttaccgctggcacaggaataccgcgccgcgaaagcagggtctaggagaaacaatagaattcttggcgatgagagaggggaaggctttaataaaaaaaaatagcgcttatccgattctgttggaataagtggctatcaatatttacatgttgatatggtagtaaggatataaatgcttatattgaatatttggaataagcatcaactatcacttattgaaaaggactcgaacaaaaaaatatgaaatgtcgaaagccacatcactgagaagttgttggattgaagctctaaaatgtcatcttttagtagtattcgtgttactagtatattatcacatgcggtgtaaaaagatgacgtaaagattgagaaacagtcatcaactgttatggaagctgaaatgcaaatattgataatgtaataggataatgaaacgtataaaatgaaaaagaataataaaatattattatgtagaaataccgattccattttgagaattcctatatccttgagaagaacttctagtatattctgtatacataatattactgcctttatcaacaatggaatgccaaaaattatcaaaatatcacccaatattcaattttattgttgtgaagacatcaagccctagatatatatcatagtaggataaaatagtagaataaaactattcatatatctacgtgaaagcatcagagattgtaatgttgagcgccgtggcgcagtggaagcgcgcagggctcataaccctgatgtcctcggatcgaaaccgagcggcgctattaaattttttgaactgtccattaataataatggaactgacgtcgtcaattaccggtagcttttttgcccacatttttaatcatcttttaagtatttgagtatttgttgttcactagagttttactaattaaggttctgagaaaataaagatatgcatttagaaaagtcggttctacaccgcaaatttctttattacagaaacattttatacaaagaggatacatagttattggaaagaaaatcaattatctttttgttgggtagtatgaatattacttgtacattatcatatacaatataaaaagatgtcatagagttgtgaaatatttattatatttaataaaagctgaagcgcaatgattgaaaacgttttaggatgattaatgataaagtacaaaatgaggagaagaaataataataacataaagtggaaataccggttatcttttaaggatattataacctggaggaaaacttcctgggttctctgtatattcaacacttttccgttatcaaaaatagaatcccaacagtatccccattttcgtcaatatctccataacgacaaggtcttctagataccatataatgacaataaccaagcccaccatttaggtggattttttgtgtggttttgaaattaaaacatttttagaggaaaattgtgatcacagaatttcacattcccagttactttaataatattcatagttagagatgaagaggtactattaatatgaaggttaagtatgaatcttctcatgcttctataagcgagggatataaaacatcgccaactgtttcatcttatttattatcaatattatgtgtgtttggagcttactatacagttaatgtgataattaatataactcttgtataactaccatatcaatgttcaattaatagatcttaaatcggtttcattactacctgaactgcatgtatgaaatttccttccacattaggcacattcacatgtaatacgagatgtacatctatatgtgatattagcatttacacagcaatcctatatcactattaatggccacttgttccaaaaagtatatattatgaagcgtattattattttatactcagatagctggtgcgatacgttcgcagattttgagcgcaatgcaatgagtatgacggaaaggttcactcataatttcaataactcaagttgtttgaatttaaaatacattccccgttagataagctataaacattgttacttgcgcttgcggcacatgtaatgtagtttctttctttttccaagaaaaaagaaagccctgtagggggctcgaacccctaaccttatgattaagagtcatacgcgctaccgattgcgccaacaaggctctttaattatgaaaaattacgtttaataagtgacttaaaaatataaatactgttactaaaatgtgaactaaaacctcaatattattttctgatcacttgatgaatagctggtaattgttggattccattgttggtaaaggctataattttacgtatatagaattgttggaataaaaatccactatcgtctatcaactatagttatattatcaatatattatcatatacggtgttaagatgatgacataagttatgagaagctgtcatcgaagttagaggaagctgaagtgcaaggattgataatgtaataggataatgaaacatataaaacggaatgaggaataatcgtaatattagtatgtagaaatatagattccattttgaggattcctatatcctcgaggagaacttctagtatattctgtatacataatattactgcctttatcaataatggaatcccaacaactatctgaaaattcacgtgattctcatgtgagtacatcagaaaacaaccacctaacaaccgtgtttgaatgttgatctgaaaacaaaaattaatctctcgtacttattatggatattgtattttctcaaaattccaaatgattttcttgttagatggtattcacggtcatcggaatctcagttcaatatcaccaatttgcttataaggtttatgcaagataacatgtttggtcttgttcccaagtataacttaagaaaaaaaattacaatccaagaaaggtaatacagaattcatagcaataatggggtccattttcaatagataatgtacctggaagaaaagggctgactaggaaacaaaaagaaaaacaaaactatgatactccatcaaacatagggaaatttactcgaatatgaaaagtacaaatctgtcaaaagcacaccgtatattgtcttggttccgcttttattcagaagaattactgaaatgaagaggaatgacgtaataaacaaacaacgattctgatatcagaaagacatcttgaatattcctatgtagtaattaactatcccagtacttacaaacataacttgacgatgcacgctacgatttttgtgtgtttaaacttttgttggttggaactcaagaagatcttctctgagataattgtaattaaatgtactttaggagtgttcatgtataatttgcctctgcaaaagcttaataatgtattttaaaacttgcatgttgctctgtgaatctgaatgtatgataatgctacgattactctagggaacttcctttttacatttaaagtttccgagatcctcagctgacaaataaatgtcatatcaagacaataaacggtagtgctaaagtaattgcatattaaacaggcgcgactaaagctttcatcccttctattattgcataacctggctatacatgaaaacacttctcacatttgatttaagaagtttactgttctaagaaaataaagaacgtgataatgatgaatgaagaggattctacagaaacgaaaagcctagtcataactaatggcatgtttatcatagacgacatcgagcgtagtaaatataatattcactataagaatgtcccaggaggcggagggacttttgccattttgggtgcatgcataatatcttccggcaatgtcacatccaaaggtttgaagtggatagtggacagaggctctgactttccaaaggaagttataagggaaatagactcatggggtactgatgtgaggtttcgagatgactttagcagattaactaccaaagggttgaattattacgagggaagtgatgatttgagaaagttcaagtttttgacgccgaagaagcagattaacgtcgatgactggatttccacatttgggcagaagataattgatgaaatgcatgcgtttcatttgctatgttctgggtctagatgcttagacataataaacgatctgctacgggtgaaaagttcaaagggcacaaaaccaatcgtgatttgggagccattcccagatctttgcgactttgatcatcaaaatgacattaaaagtgtaatgcagaggaacgatgttacggtaatattatctccaaatgccgaagaatcaagtcgcttatttggtttaagtagcaaggaaccgactagtttggaagaatgtctagcattagcgcatcgtttcgatgatttcatggatgaaaacaatatgtgtattctacgatgcggtgccctcggaagcatatcggtaagtgagaagtttaagaacggacgaacctatgaccatttccccgcctaccatttcaaaactcagtctaaagtactagatcctactggcgggggaaactcgttccttggcggctttgcagtttcttatgccctaacgaaaagcttagatattgctagtatatgtgggaacatcgctgcaggcgcaataattgaacaattcggaataccgaggtacgatccaattgctaaaacctggaacggaatcacattcttggatagactgaaattttacctttcacagtccggtcttcaatataatataaacgatctttacaaaagtctaacacgatgatcatatcagcttgttcattgctcttatttttctgcaaaaatatacatatatatatataagtaagtgttatatactacttgagattaggcgttgtaacaagattcaaaaaattcgaactcgaactgtgaaaccttcacaaatatgctttccacttcttcgacgggaaacttgtcaacttcagcctttagaaattcacaccaagtttgaaaatgctcaccatcatgtaaatcaatccatttttgatatttccaatgcaaccctggggctctaggagtatcacgagcccatctccaatagagttcctcagcaacccataagctggttactaaggatggccatgtaattgaggcgtcctttctcagctcatctaagaaattaatatacgcatcaacgccggggatcgctttattgtcaaaattatctctttcttccttggtgagggatggtgccaataattctaagcagtcatgaaagtatgagttttcatcattagaaaaaaatccaatctttttggctaaggttattaaagcgtgagtagttggtgctaaagaagtcgtcttacatatcaaccttaagctagtttcaaaaaattgcagatcttgtgataaatagatgtacaaactacggtccttcaatgttccggcacatagttccttagcgaatttatgttctgtggttttcctaacaagggcgtcgtacttttgtattaacttatcagtggtacagctcattgttcttccttgcagatattgttgatattgttattatttgcgctaaattttagttaatacagaaaaaaatatctaagttcagtccagttcatattcgtttatatatctttcgaagccagaccttttttgccaagcaattgttactatggaaactattagaaccatatgcgctaaacaatattagccatcaattcaactttattcgcagtaagctcctgcagaacaggcttatcaatcattatggtcttaacggaacgcctagggacgctgactaggcccatcattctactactggagcccatacgttcctcaacatgatctaatagcaaattcatttgggcatctacagcaaccaagcttccaactaaaatacgatcttctgtaagggaaactattaaagtatttccaataaaatctgacagtttcaagatgtccatgacgctttggtgccccttactaagtttgttgaagactatcttcaccctatcaatgatatcatcgcatttaaaaaatagtcagaactcatgcacttcgcgagatattttttgaaaaaaaaaaaattaatccgccacataagatgcacaaaatgagcctataacattgaattttatgatagaacgaaaggattgtgttatttagaacagagtatcagtatatcgtatgtcacagaacaacacaatcagctcaatgaatcctgaaagagcttacaacaatgtaacgctgaaaaatttaacagcatttcagttattatctcaaagagaaaacatatgcgagttattgaacttggtagaaagtacggaaagacacaatagtattatcaatcctgaaaggcaaaggatgagtttggaagaaatgaaaaaaatgctcgatgctttgaaaaatgaaaggaaaaagtaggaaaacgcaacattcacaattgtaagctacaaaatattgaatgtgaatcctgcttcattacaaatgaagaatttcaaagcgtatctagttcaccaaaagtcacaatatcttattattatttggaagcttttatatgcatctaatggtcataaatcccatctcactttataaaacaagttaccgcgaatgtatccagtgatacagaatagagtgtaacaaatgagaataaaaataccatattatcgtttaattttggtagggtacgctaaaataaagtggtgtttgcgtctccatataactaaaaagaattgaaatggcctactatcgattagactattcaggcatggaagcagtaagaacatttcttgattttggaaaaatgagattagattattaattattattgagtttgtgtatataatttattttgcatatttcataaagaaattaaaattagattattaaatattaagtttcattagtgacattaaaagaagaaaactgatgttttgaaatgtgttaagcaaagaatgattaagacaatctcaagctgctctaagcagtatcttcgacagcttgctctgcttcaggttcgggttcgtggattgcagtctctccagatgctcttgggctctctggaacagcttcttttgtttcaggagccgcatcttccacatcgtccgtagcatggtgatgagagaatcctcctgtcaaagatagccttggcaatttgccatcacggctgactgcaattagcaagtaacatggataaatggcaaatacacataaatccaaaacaccataaaagatagcctcaccgtctggttgaatacggttaccaccatcacttagaccccaacagataaagtacaaccaaacgattaccatgcaggtacacagcataagtgcattgaaccctctagttttcaaattgaagaattgacgttggcatatcacaccttgggtaaccaacatagcgacagcaccaatggtgtaataaccccacttgtaggtggacttgatcaatgaaccaactaatagcgaaacaacccagaataaggtacccacgatttgaattaacagcgaatgtaccatatccaaggcggaaatgtcgtcattctcaccagtagtactagcggctaactcgattaaaaataaaaggcatggccaggacaagaaccaggcaatatatttcgagtaaaagatttgtctaataccgggaacttcacctgtgatagacttgctaaccttgacgtggttaaattcagcttgaacaccagtccaacctaaatcagaagcataagtgaagaaagcaaaaaattcaaagaaagtgatcaaaaatgcaggagctaaggcatatctagtcaatctggagcccttgttctccgcaatgaagaacatcacaacatagcatagcaatataaagccaaagactgcaaacactgcccataaccaatccgaacctctcttggtaatgtgcatatccaggccatgtggtggattaagccctaaagcctcgttacgatttaaaaagcttgatagcgtatcgttcatttgaaatttgttgtttttagtaatcaaaagatattaaagtctcaaacttgttgttttgtttttgtaattataaataataataattgagttaatatttgttgttgtgttgtattgcagaatgtaaaaacaagaaacaagattagaaagtgaataggtgttacgctaaataattgaagactctcacagacttatatatgatttttttagtgtgatacaacttgtaatgaggtaagggattgatattatactttctaactgatgatgaatatgaaaactttggccaattagggagaggaaagttttcgatgagatgctagaaaaaaacttgtccttgccatagcagaaagggatgatgaaataacgaagatgagctaatttggtattcgaataaacatgcaggatgtggcggaagggatcggaataagagtcgggatcgggatcgggatatggctttgcttactttagccataccaaatattcttacaaagcacgctttcgatgcgtttttgccttctgagagaatcctcctacggctcgacccttgaaaaattctagaggatctggaaaatggccaacaaaatcgcgcagggagacgcaaggaaagtaagtcagatggatccgactgtatgtaacaagggttgctgcagcggttttccatccctttcggcaccctgcacaagtagttattcttacttatgcaaaacggatatgagctacatagcgttcattttttaggttttcagaagctattacaacgcagtaaaaaggatacacaactttcttacggggaagaagaatacggctcaatgcacccacttcaacccccggtatcacgcggcactaaagttgtttgattgtaatagtaatactgctgttgaggttttcttcttcagggctgctcacaacgtgatatatttgaattgacaggacgtattcagcgcagttgaggaaaattaacatatgacatgcgcaggaaataagtgctcaagttttctacttttgaagaaaggactttggtttacttgcctactatctccatgtcaagtactcggttgtatgatgttaaggagcgcagggaacactaatcgataaaaaacccttattggctattactaaatgtaacggccgtgctctagtgaaatttgtatagaaaaatgggttctctcgctcaaaatgggcgccattacttgtctggtcaaattgagttcctggatataattacataaacggattgaaatttacataaggagtataataattccggaaactatcttgagtgcaatgccatcacgcggccatgccttgacataacatgctctcatcaaaaaggtgcaaattttcgccagttatggttgatatctaaaatctactggagttcatttttttttttattagatatcctttttgcaagccttctgaaaaaaaatttctcatgtggtacagcgttggttacttaagctgcttaaactagatcgatgagccattcttaaatcagaagactgtgactgcgaattgtaggcatcttcactaccctgtccatgaagctcattttcgttatcatcaattggtgctatcttataactttgataaagagctaccatacaaaaaagacttaacgaccaccaactgacccaggcgacgtcattttgctgggaccaagacataatatagccccatactaagggacctatgaaacgagcagaggcagaaatactaatggtggcgccattgatgactgatctacaactcaagggactcgaattatgaattaataacataatttgtggtgacgttaaagcgccacaaaatgtttttatccctgtgattatgtacaagtagacgacagtataccagctaggaatccgttcattctgtagaaaaacaacgtaaggaaccataacgtacataatagggtacagcttgactaaagttctgaaaattgttaaacaatcgaaatttcgatcaactatgggaaaaatgaaaataaccacaaaacaaccaaagatacctgttgtcgacaaaagagtaccggtttgttctggttcataacctataccgccagatattttccacggaaattttgaagccagcttctttggattttctggatctacggctaaatcataagctaaaaaaacaggcaaaaattcgttgtatacaatcaaatgtaaagccataataaaattcaccgatatagggtaaaatacttttgtatgaaaaacgtgatgaaatatactactttctttacaaccgtctggagctgtatctatattggcatgcacagcgtctgttggttcatgcagagaatatgtcctaatcaggcctacagactgtcttcttgttaaaataggatcaatcgattgtatgctttcagtatcatcgtcattggtagtattcactaggggactattttcatcctcttcactatcttgtcctcgattgctgttcacattctcattacggtggtgaatgttttccgaatcatcctgaatgcgcttttgccagggtcttcttttcggctgtataccaaatatattcttcttaataaaatcaccgacctctaaaccgtaatctcttctatttttaaaagcaggatgtgtttcttccaaaaacaatgttgcattagttaaaccaaacatcaaaaacatgcacactaccacgtttggcaaggcgtacggatatgacctaattattctttttgcaaaatgtggaaaccatagtggcacttcattcattgttccatctctaaatacaagaaacccaccgatcataggcccaacaacggcaccaaattgaaataataaaggcatagtactgaaagctaaagcctgatgttttctttcagttgctatttcaccaataatggttctaataacgccgacgttaccatttagcaatcccattaaacttcttgccaccaaagcctgatagaaattgtgtgaaaatcccagtattaacaatgatacagatgttcctataagcccgcaagtcaatgttatttttctgccatgtttttcagagaatctaccccagtggtacgcagatatgacttggcataacgcaaatgatgaagataaataacctgaatatttggacacttgagcatcattgggagcaatattaaaatctctaaccatgaaataaacataaggaaatagtgacgaaaacgcaattggttcgctgaacctaactaaggacacaacaacaagttggacccaggggaaaccatccatttgttctttgaaagtaagcttttgacgcgccatatcttttatattcgtgtgttcatatgcttaccacttcctagttccttggctagtattcctttaggtgatctaaattcaagctctgtggataaggaccattatagtattttttactaatgatagatactttttgttatattttgttttggcattttcgtatccgagatttccaatgagcggaatgtgtcattctttgtcaattaacatagatcaggccgaatgccaaatggagtttagtaccttcatattgaagaaaaatgctacattattatatttacaaggatggtcttaaataaagcttacttttaaggggggaagaatggtgaacagtgagtaaatacatagaaggagataagaaacaaatggaatatcaaaaatcgatggattctgcagatgttctataaaagggtatggcatcctttatattatggttgccatataagtatgagataaatctctcaaaccctagaccaaagcctccgtgtggtgcacttccttcttttctcagagaaacataccagtccaattctccagatctattcatcccgcgtgctttcatttctctacataacttgtcatagtcatcttcccttaaactcccaccaattatttcacccattccaggaaccagtagatcaaagcatccaacagtatcgtcaggagtggaattttgtttcatgtagaatggtttacaaagacgtggatagtcggtaacgaaaactggggacttaaaatactctccggctaaaaatttttcatgttcagtttgcaaaggctgtccccatttaggttcatacttaaagtgtgaaacttcattgtggcgtttcttgagaatttctattgcattggtatacgttatattgtgccatttttcatttattaaatcttcccatcgtgttttaatttgttgtgtctcttgatttattgatagctctgacgatgcattattttcttgtgaagagataaattgcttcggcaagagttcttgttggttatctatacaagctttaattatgtgttttattgtagtctcaacaaacgatgttagctcgttgacgctattaacaaagcacatttccacttcaagcatccaaaactccgaaaggtgtcttggagtatcactcttttcggctctaaagcaaggagataacgtccaacaccttgacagtgataacgctaaaatttccaagtgcaattgagtggacacagtcaaataagtcggcttcccaaagtacgaggatgcagttggcgacgtattggtggagacttgaaacaactcgccggcaccttcacaatcgtttgaagttaatattggtggtgaaactttggtgaagtggtttttctggaaatatagcatgaactggaattctacaaatgatcttaaccgtaaaattgcacttaagtaagcggttctgtattttagtgtaggtaaggaccttaaataacgtaaggtttgatatttcttttgtaatggatagttttctgaaacgggacccacaagtttaattgacttgacaggatttttgatttgcaattcaaaaggttgttttctattaggggtgctttgccaggtagcattagatatagataaagtttgaccagttttcagaatttttaggaactgtacttcatcagtatttgtgagtggaataactattcttaatgggttcacagaagtcccatcttgtaaatccaaaaacgctatacgttttaatagtcttatggatttgatccatccattaattgaaatgggatcatggctagtatggtgtacctgctcgtacaatgatttaactgttagtgaagagtaaaatctaccacctttaaggaaggtgaaagcatgaaacattagctgtttgtattcgcttgttctctttctttctctcttagtaagcgataagtcgaactctacttaaattgtggtacgttttctttttttcctataatataaaaaagataaaaaatcaggacgagaaaaagtagatcataactataagttgtgcatactcatactccacactccacggcctaatctctgtaaggattgtattttattttttatttatttattatttagattttctaaaaataaaaaaaaatcatacactattttgattacactactatgtaatttatctttgaaaacaaccatgaaaaactcaattttacacacacatgagttatcatgaggagtcatcagccagacttaacaatcacacacattgttaagagtggaaaaaaataatagtgataaaaggaaaaaagctaacaatttggattttacgggatctgtctaaatacgaaacacacactcgttttagttcaaatatcataaccataaaaaaaaaagcacaattcaacttgagcacgcacactaagtagtaacaacgttcatttacagtaaagcgaacggacgaaacaaataaaagaaaggcatagtgagggataaaaggtagaaagaattcaaaaaagggtatcgcacacacacacatagtagtctaattcatgttctagaatggatataaacaaagatgaaggggacaggaaataaaatggctcgctccgccctttttagaatctttgcaatcctctttgtctagcttgccattttctgtagataatggtagcaataatggcaatacaagccaaaccgaccaaaatgaaaactaaaataacaccacctggtaaagtcatttatgatagattaaaagtgctgaaatgggaagaggagaaacaaacaaaggatatgtaggaacaaaagtttgcttgagtgactagtttgaagttgagaaaaaaaaagagatgaaaaagttaacttatttgctcttccttcaaagtgtgtagcgtcttcctttaaatactattgaaagggaaaaagaataaatggaaaaagggtagtaatgaaaaactctaaaggaagataagacgcaataagagaaaaaaagagaagttaagattacaagagaaacaataaattgctttcaaagctttatatactggcaagcacggaaggctaaatttgaaaaaaaaaaatgggaaattattatcggaaaaaattgaagctatcttctattacgcagtgacaagtctatattgacatctttctgctttctgctttctgtttgttgttttttttctcatagttgttttgattttactctgttggaaatgcgagaattgttttgattttacccgattgcgacctattcccggctttcccaaaaaaggaattcctgtccaatgcaacgacagccatagaaacagccgcggttgggtgcgtgggtgcggtaatttaacgatcatatggtatgggtgcacgtgggatgctaggggaagtgcgcgcggataccgaatcggccatcgaaccggccacccggattgaggttggtatgttgcctctttgcgcaattttattgaatgcaaagtttctccttctagtaaaagacaacagctgaaaaatgctcgatgtccaaatgacgacataaacctcctcgtttaggaaagagttaacacgcctagtttcagcttgtttctttttattgtgtaattagttttcttacttagtacatcttattgaccccactgtcatcggatgtgagagagtggttcacttctgaattaagtttagagatatactaaatctaaataaaagtctctttctgcgtgcatatgttttcttgcgcgggactcacaaggatgcgtcttttatttcataacgcagttgtcccaccttaagcttaggtatcagaatcgactaaatcgtcgatgctgtcaattatgtcgtcaatgagatcttttgcgtcgttgattatgtcttgaagccaatcccccactgtgctagcagtagcgctagcttgtatgctgctgctgctgcttcttcttgatgatggtgatgtttcgcccggtagagtctcagttgctgatggtattgaagttgtcatttctagttttatcgttaatgacgaagatggcatagcggctatttcatcagtgtttccatcgtcgttgtcatcattatcattgtcaacattgtcttgttctgtctcttcggggtacccgccccaaattatattataagtgctgaattcaccaaacttactgaccaaataatcaaagtcatcttcaatctctacttcttcgctgctctggggttcgcggagttggttcataagcatcccagtcccatcattggaatttctgtccttttctgccacaccgcaaatatcgcacaaaaggttgtaaatttcggtattttggaacggctcaatgtatccctgtggaaaatatggccccataccaataaatacagatctcatatcgatcgcgttattgtcgtatccatgtgatccaatcgtgaacacattgtcttcgtttttgtccttatgatcaccttttgccaccttcttcaattgttctttcttcatcactgcatacccaggctcgggcacaatccagattgacgccatgtgatgattttttccatcattaaagttccattctttggggaaatttccattaacgtaaaccgtatacttgtcttcatctatagaagtctttaaattgtggtaaacctcattgatgtttccggaatctttcaacgatatagccatcatcggaccctctagatatgcgtgcgatacataatccttcctcaatttttcgtccagtaagtcttcccatataataacatttgagggaactacgatatcgctcataccatgatcgctaacaatgaccaaattagtaaagctggttaaatttctttcttgcagcgattccactagttgcttcagaaatgtatctacttcccccagtgtttcagtgaagtcttcataatagtattccgactctgacggatatccatgcttatgtccaaaggcatctacgttcggtacataaccgagaattaactgtggtctttcgttcagtgtactcatatccacatattcaataatcttggataatttttgcgaaagtggttctttagcattgaattcgtcgaagtaaaatggagttctctctctagcaataggctttttatgttcaggttgtagtttctcttcagtcttatacttggtataattcacatcgctacctggccacatatgggtagcagctttgaatggtatatcaccgtcaaatgcagactgaacagtttgccatattggttctgtatcattattgttccatattcgagggtccaatacacctggatggaattcttcattaagatcaggatcccaaaatacgttagagactataccgtggtgtattgggtattgtccagtaaccaacgtccaatggttgggaaaggtctccgtagggaagctgggtatcataaaaggtgtggacgtgatattcatacctccatcatatttcaattcatataagtcatgtaaaaacggtgtgttcctcttagatatgagtgaaggatggaaaccgtctagtgaaattactatcgttaaggggaaaaattcatgcgtaccgttaaaatacttcacgtaagggtcaaattcaggactgccaaagtgcgatagcactctcgtggagtgatggggttttgctatgttaatcatcagaattaaaaaaatggcaaacaccagcgagccaagcaatgtgcgaaatattattttaaaaggcactttggaacgaaatcccgttccaaaagaaagttcattctcatcaacaagttcagtatcaatgggttgaccattcgcgtctaattcatatagcggtataccccttctaaagttagaaccatccctactatctttcgcgtcgccaatcactatgggattgtttgtccacttcagtctattcttataaaaccaatatttcatcctggtccacgcagatcgccaccccgatcttacagcgtcttcatccgttatgaaatcatcacgaaatggatcttcactaaaatcattcagctcgttatcgagcgactctaaatcattctgaagttccatctatagagagtgttatactgtacctcttttcagatatatgtaattacctcgcctcacttattttgcttatttgtagtttgttaggcagtttgcatatcgtaccaatgtttttttataacttcatgtcttttcttttttttcatttttagcatcgtacgcagatatcttgtctcgttatgatattttgtgagataggtatccaaaattaataagagaaaatgtcgtattgtgttcacaattcgcctgattgtttgactagtccaacccctggtataattgtcacttaatatattcttagcttccaggtggtgttttattccattatttatgttatgtatatataatcgtaactcttagagcaaaaagtaaaaaagaaggtggtacttaccgagggagaacatatacaaatttattcgtaaatgtaaataattaattgaagcagagctaaaagaaaaatacaagaaaatttatttacactcgctgtttggttctgatcttttggtattcacaattttagtgctgtccaaaaatattgcgatgtgctgataaagtacatagtgtgatccgacttcgtcccagtcaaagaaaggatgaaatattagttagtacatttactggttgctactggatgtcctatctgaatcttccatcttaggtacaaaaagattaagaaagtcaaattgtccttagttttaaaagacagagttacttcatgtctttaacatcaacagcaaattactttgaaaaaatgcactaaaagttaacacatgtaggagcattctaaacatgaaatttttaatggtacttaggtttgctaacgcatcttgaaaactagcaaaaaccccataattaaaatattcttgcttgttaaacgaggcgtccaagccattgaaaggttttatcaatattcaacctcttactataaatgcagcacaccgtaacaggtatgagaaagatgtggtattattatacaaattgtactgaccgctttcctactaataaaaccaatgatatcctagggacgctcgagttttcacattatagaacatttattattattttcggcatcaagccccagagttccttcgacacgttccatttgtttcaaaaggagcataaaagtttcttcaacattataatctaactcggcactgcattctataaatgctgcctggttcctcttatcttgactgccaattgtcgaagctagtttctctccttcagctttcgtgacacacctttttacaccttttgtactccttcccaaatcagctttggtacccacaagtattaccgggaggttatccttacccagctgatctaccagcttgtcccagagaatgggaataagatcaaagctagcacgatttattatactatagcacagcattatgcctcgtacgcccgtcaacgatttaatgtttaatagagaaacttcatcttggcctgcagtatctagaatttccagagtacagtcatgacttttataaggaattatcctggtaaattcattttcaatagtgggataataggattcaacgaaccgcgattctacgaagcgaaccgttaatgtggttttgccgacatttctagctcctataagagcaatctttctctgaaagttatgtgtggagttcgaagaagacatagtggcgtattccattatgtcacaggttatatcttttctcgccgtgccccaataaaactgtttcggtaaagagacaattcgaaccagcccaaaagaatgaatatgaaaatatcagtatgcgtcaatgaaaatggaggcaagttcaataatttcactggaaatataactagtaataattcgtgtaactgctgtagaaattgttagatattaaacctggcagaagcgtcttgttaatacttatagagaaaccaccagtagcattcttctgtatctgaagatagtgaaaaatcaaaaaaataaatctgtattcaaaaaaaggtcctacccggattcgaaccggggttgtccggatcaaaaccgaaagtgataaccactacactataggaccaggacttcttgtagtatcaacgttctagataccaacatatcaatataaaaatactgaatattgagtcatcttttagattacgttttggttgccgcaaaccaaaagtgcaatttaaatgggtgaataatttgaatggttggaaatctattctcggtaaaggttataatatcagtgttggaataaaactctaaaataccatccattcagaagtattcatgctactagcattttatcacatgaggtgaggtgtaagaagatgacataaagattgagatacagtcctcaaacctaatggaagcgaaatgcagggattgataatgtaataagataatgaaacataagaaacagaaggtagtagtattattatgtagaaatacccattccattttaaggattcctatgtcctcgagtagaacgtctagtatatacgaaatattataccctttaaaaaacactggacccaacgataatcacaacattcaccgatttctcacctgaacagatcacgatcatccttcagaacatcttgctgtagccatattaaattcctttgtctctggactctttctcgcgcgactgatctcccaatgaagaattgtgtcaggtcatctcgtcctcaatttctaaccaaaattggatgattttagttctcactgacgctgcttgaacgttaacaccgaaagagcatgcaataatcacaacacggtaaaccaacttgtgtcatatttaagagaaatattaaaacgctaagaagatagctcccataatagaagtacaagttatatttatcgttgcccaactgcagaagttaaataaaggtaaataaatcgagctaagagaaaaaaaagtataggcaaaattccgaccggagctagctttaccttgctcctccacctaagtcacctgctcaggtcactcaagttcacaatcttctgagaggatagataaaggaaaaattggaacagatcttttcatggcctggcagttgtctgtggattggtaaagctctgtcagtgaaaaaaaagttctcgctccttcttggtctcttctatttcctgagattctaatgctttccttacattgtttcataaaataaccaatttttcgtgtcacaataatcttgaaatttgaagtttctaaaatgcatcagacatggtgtcgtagttagttgatttactttaacttctaccaagaagtagaaaatagcagagtgcgtgaacgcatagcagagaacaaaatacttactaaacgttttcgaataagttagcaagaagcttttaaaaacatagacttagaaattgtcctgcacttggcaaggaagaaaagaaagattagttaaacagaaatcgaaaaatgcatgatgaaaagctaagtagacctctttagaagtgtcttagcggctattgttcatgatacttttgaaaagagccctgagattttccattaccatcaacaggaccaatgaatagctaaaagaatcgaatgtatttatcggaaaggatttgaaatttcggccatttcctcattatgaagttcaacttccatactctcgtcgtcgccatcattttcattatcctggttgtcgtcatcgtcatcttccccgggcatgtcattagcatctatataaggaacctgtttcttagacaaattctcttttatctgtagtgagcgtatgacgaccgagacaattccgcttgatattgccgtagccaagagggcgtagcaacctctctcaaacttgggcaccatatctgaagcaaagaataatatagaccaccatgcgttaacggcccctgaaaacatattcattgaagcaagaacgatagcacgttcttgaagatctgcatgacaaataatgtttgcccacgaaaaaaaaaccgcttgtccagcgtatgctacgcctccaagatactgtgcagaaaagacgacttttggatttagtgggtctgcacgtattagtaccgcaacaataaccattaccaatgatatgaaaacagaaacatgccaatgcctagctcttgggatcttactcatatatacagcagaacaaagcgtagaaactatacctacggcaaatatccccgaaggataattatttctttgcgccaacgtatatttttggttttgtaaccataatgcaaatgtagaattagatgcgaaacccaaattctcacctcccagaacccaaacaagagagaacatccaccagtgccacctttttaggactctaggaatagtcgaccagtctaaccgggtgctttcgtccctagcggggagccttctcctagcataatgtagctcttgttcattaaaaatgtatctcgtcatagaaaatttgctaacagcacttgtttgatcaggaaggccggggaagaaaataaacccataaattgcaatgggtaatgtgatacaaaaatcaataatgaataaccatctccaacccgccaagccattccgcccattcaaatgagtaaagatacttgtttgcataaatccactgaacatagatcccaccaaaccgctacctgtaaaaatagcacttctaatgggcaattcgtcttctttataccacgaacccaaaacaaaatgtgttcctgaaaatgtgcaactctcaaataaggcttgaaagaatctaattgcgcaaatatgtttgaacgatgtaactttgtacattcccaaggtcaataaaccccaggcaaacgtacaaaaacttagccatatcctaggtggaacacacaataacattaaattattggggaccatacctacaatgtaaccaatcatgaaaactgtgttagacacggtcaaatcgtttccgaccatcttaagatcttccttcatacccgatatatatgcattggtgaaaccgacacggtcgacataattaatccagtattgcaagcaaacaaatgatagcacaaacaagtctattttaaacagaagtaatctctttttaatggcacgtttggaagaaacagattctctctcaacctcatgttgagtgatagatttcgattccttcatcatgacttaggcccaggctctctccaatcaaaaattctgaaaacagcttctcaatcttgaataaatcggaatacttttatatcagaattacaggtccgcctcatttctcttaagagccgatgtcttcctttacaatatacgcatgtagaagatttgatcgatgctgagttcttgtaattcgtcaaaaatgcctttcaagatcgattactcaaaatctacaataatcggactgcatggatcaatggaggtgtagccaattttgtaacaatgaaggatatgttaaattcgctaaagcttcctcctcttttgctaaatttcatcatcaaaaagcattttgcataacacacgttaaccaatatattatagtatatatacattctatttgagaataagcatagtttttacataactagttcgttattccaaatgtatttttcctatttgccataaatattttaagtaaaagaaagcatgctctagataaaaaatatcgaggaagagtcgaaataagcaagcgtaaatattacaattattctgaagaagcagcattttcttggccctcagcattttcttggccctcagcattttcttggccctcagcatcttctaatttcttcccattcttcaataaattaatgtccttttgaactaagctcaaagtagtacccttagaaccgtcgtctctctcgaagacatagttagcagcatctgcttcaacatataccaaagcgctgaataaattatgtaaaggaaatgttagtaaattataacgcgtaattgtaaagtaagtaaaattgaagaataaataacatacccttttctaacatattctgtcaaaaaattgatttgaggttcattgaaaacggtgatattataccaattggtttggccatctcttcttggttgcgaagcgatactatatttcaaataacgattgttattagcagaagtatgttcagtgaattcagagccaatgcggccgacgatggacattttcgagaagtccatcttcttggtagtagcatggaagaaacgagcttgagtacgtaaaaacattacaaaggattagtggatttttgtttgttttgtatttgtcaaggacacacaattagcaaatgacttgttatcaaattcgtggtatttgtctttctcaactactgtgttagcttttttttttcgcctgggcgcaaacgccttttaagcactcctccacaaataataagtattagatgaaaagtcctaaaagtccgaaaaaaggaatagaaaagaacgaaaatacagaatctttacagaacattatagtacataagtgtagttctacgtaagtcttaaacaaaggtttcaaaaggaaaatatgatttagcggcgccacctccataaattatggattagcaaacaaaagaacaattaatattgaaaaatagaagcatagcagaaatatcaagcgagaccatggtagttaccagtagtcaaagttctttttgtgtttacatcgagccactcaccaccaaatggattgttttcatccagctcctgacaagtcaaggtgattccactgccgctgccgctatggggtagagccgcgttatccgtctcactgatagtgaatttggtaatcacgcctttagcggattcatgtgccaggccgtctgtaataaatctggcgattaatctttgaccttcaccatttcttgtcaaaacaactggttctttaaatctccacgttattctcttcttttctttactgaaggagccctgaggttttgataaagcgcttgttgcattagcaccatcgatattcacaaagacaacgaggtcttctattacgatttgtgatatttcatcgggtaagcttggtgacatcttgacagtcaatacaacacttgcctggtgagattcaaatctccagaccggatgaataacaataggcgcgatcggctcctttatggaatatttaatagctcctaaggttctagaatcgataaatgaagggttaactttgaattcttctggagcaacacgctcaataaaggcttggttcagaatgaccttttcgaacttagcgccattattgattctcaaattaataccgatagtaaaggcgaattcatgacagaattgggtaaatagttgagggcaatttccccaatcagttgggagttctgcaacataccgtctttgaaagaagcattgagcacttctgcgatactagcattcaacccaaattgagatgtatctaaagaggagtgctgaaacaacgattgaccaactaaagatgttgaagagcccgtggcttgaggatttagttctcttagctcgccagtaatctgagaggagagtgtggaaactggacgttcctggggaatagaggacaaggaagaagaagtaggggtagcgcctgagccgtgattaggcaaagagtcatagagttgagaatccctgttatgaatgaaattttgtttccttgagggtggtaaagcaggtgcgcggatatgcaagggccttgaatcaacttgacctgaaggttggttatcaaccgtagcagtaggaagtgaaatactgggagaggcaggctcaactggtaatggttttgtttttgattgtggctgaagtggaggttgagaaattgatatcggtactgtcttgggtaagttacttgagtctggttctttcgcagtgggtggagaactttgttgtggcgttgaaggaggcacttcagaaggagtaaaagtttgcgcaggtggtgtatcggcagtaacaggtgcatctacgtttttaggagtagcatggggaggaagaggaggagtgtcactagcttcacccggggtccaattgtttgattttgatgatgaataggtgggtcgacgttgcttctgataaatagaagaagttgcagttgaagacactctggtggaagaattattcggagtctcagtgatggatgcctgaatatgagagtttgatgatgattgctgttgtctcttgttcttggtcttatttctaccgaaaattgagcccactttagatcttagggtgtgggacgacttttttgatttcaaggaagaattattagtagagtctgaaaattcgttattcatgagatcattatgagtgagactggaagatgcagaggcaagacgatgtccaatgtttccaaatgcactcttacgcttatccttttgcggggatttcttttctctttccgtattagcggcaccattggatacagagaccgggcgggcaccagtggcagaagctggcgaagcattattaggaactacttctttggaagaagaggatagttggaagttgtattgactggcatctttggcaaaacgatcaatttcactttgcggttcgaatgccaggaatttcgtcatcaccgtttcgcattctttggtagtatttagtaaataatcgctaaaactggtttgaaatctaagcatacagttttttaaagtgtccaaacggttatagtcaatagtctcgaacagctcaaacaaataggggctttgctggtcccattgccttcttgcctcttctaagtgactagagttttcgttattcttactatagtgctcaattgaagctgcatttttactaagcttggaatgtaagtccttgctttctctccagctagtattgttctccacggattccttcaattcacgaacgacttgctggtccaaagtgttgtagtattctgtacttgacttcaaatctgattttagttcttcaattacagtatcccatacatttcttagctctcccagcgagttgaatctgaatgcactcatttcctgcggagtcaaaacattactttcaatcatttgagcgtttaagatctttgttatatcttcattttcagctattatttttctcaattgctgagcatagttcctcttcagatttgccaattccttaaataacaggtaaaagtctttattcaacaatttgacctgcgataacctgattctaatagtttcggtagcctcgtaaggactcttagtagtcaatatgctatctgcatatttggttctttgttccgtcatgagaggtgattattcgcaattttcaaataagcttgcttcaatacgactacagcaaaagtaattcctttattaaggcaataactacgagaccttttctttgtatttcgtgaaaacttgaatgcaatatagagtttttcaatctgcaagtacttaaggggcccttttagctacacataatatagaaatgaaagatcacgggctacgaaaagccattcataatcatatacaaatatcacctgtaatatataagaatatatgagctattgattttcttctaccgcctgatttagttgttttcactcttcaaaactaaattcagtattagcgacagtggaggtgctagtactctgtaaatgaaagtaaacgctggtattcatgtagagcaccaacctgactgtgaatgcgtaacgtgaaacatgatagccgcctgtaaaatattgttatcaataagtagaccggcttacacgaataggattcgctttattctttactccccactcaaccctaagcaatgttcaaaatagtgtgagattattttatgcgcgcctccttcaaaaaaaatttacatatataacataggtggaaaaacttccctccgatgtctaataagttaatcaatagaatgaaatggacacgaaaaggcgtagacatggaagatgacaatgacgagaacgtcatttttttttccacgtattttaaaaaggggtagcctgcttcaccagatgttcttgtcaacaaaattctaaaatgatgatttttttaaacacaatttatgctagatagtatctgaaagcattcaaactttatgattacagtgttttcgacagttttaaatctctgaaccgattttgcaactcttggtaattgtgtccttacatttccgtagtgacgttaatcaaatcgcaatcttgaatcttcttaactaaaaggttataagggcttttttttattactaaattaacgtatgagctgatttgattatgggcgctatataattatatgtacacattttttaactgtaaaaaataatacggcaatacaagtacaatacatgcataactcataatcttctacctcttctaccacccttctttctggtggagtcagatggaactggggtaacatcttcgatacggccaattctcaaaccagatctggccaaagctctcaaagcagcttgaccacctggacctggagtcttggttctagtaccaccggtagctctgatcttaacgtgaacggcagtgataccgacttccctacacttagcggcaacatcttgggcagctaacatagcagcgtatggagaagattcatctctgtcagccttaaccttcataccaccagtaactctggcgatggtttccttaccagataaatcggtaacatgaacgaaagtatcgttgaaagaagcgtaaattctagcaacaccaaaaacttgggaattgtcacgagcttgaacaacgtctaaatggaaatagtaaatcgatatcggacgatatcaaacgtaatgttgttagtatccaaaagtttttttttttaattcttacatagtatctttgcttttccatcgaaaaaaaagttgacaaaatatactgccattgacacaataggctctactaatcgctatgaattactttggaggcaatgaattcgttgaattgtctttatgtttctgactttcaatgtatcttgcacgtcgtcagaaacattcaacaacaatcaatggaaaatagagatgctttaaaaatgttcactatgtgattaaacatactagacatggcgggttcttgtggtttcttactctccttgggtttaaaatagaatcttcattaaaaaaagtgctttctgtaatatatagtgattaataaccaattcatttcaactgtctacctgaggaagccctgcaccatatggaatgagccaggaagcgggatggtctgccgcaagcagacaaatttgccaaaatgcagtagagaatggcaatgctcgtgctgaaggttaaaaaaagaacgcaaaaaaaaaaagagtagtaaaatgtacagatgtttattaagtccgtacaccgcacgtaagtactccaaagcagtctctattacattttaaatagggagaaagaagatacataacaagtatgaacaagaacgataatcagtgagtaaaatgaatagagatgtcaggcccgtgtgaagtacttgaaagtaataagtgagtatatagaatataccagaacttgtaagctttcgaataacaaaaagagccatttgtacttattctcgaactcggttgtagagaggacgttgccttgaaagtcacaaatcccctacaataataccggtccttggaatgtaaattattttgttaattttcttataagttcacagttgaaaaaacaacggtcacagtgaatcaataaaagaaggatctcactttataaagaaaagaacaggaaaaaaaaatgtatatctgggtatattacccggcccttgataatatttttcaataattttgccaggtaacaatgtgattcatgcatggcttaaagaaaatacattgctgaagcaaaagctcaccaaaaatttgcgttgcaaagctttgtttgcggtatgttaataaagttaccatgaagcttttttcatgctctcagaccataaagacaggaagcaacttgtcatatctatttcgacttcagcggttattttcttcagcccattgataaggcgatatatgcctagaagaaaggaagagtgcagacttgataataaagcaagaccaagagcaactaaatagactaaaatatagagccttccaaactgttagttattattacttaatactcgtacgggtgatgaaggtagtgactttgtaatccgggtaatggggaaaataagaagccttcaaagctatagcatttgtccctactgcatcggcccctttccagtacaatagaatctcgttgatgtgattactgattcaactgacccaaataaatcatttgaagaactcataaaaggactatagcagcaagaactgcaagccaattggttctttctcctttctgccaaaaaaaaaacacaatacggatatgaattcaattattaatgctgcttcgaaagtcttaagactccaagacgatgtgaagaaggctactataatattaggagatatactgatattacaaccaattaatcacgaagttgaaccagatgtagaaaacttggtacagcatgaactaaccaagataatacaaggttatcccatacaggataatatgattattaatagcaaaaaaggcacagttgaagatgacttatgcgaactcaataactatacctgttttgcactttcgaaaagctttgatttatgccatgatagcagaaatttcaacatagcgcagccgaaacgatggatacaattattagagacattaactgactcagttagtttcgcagttattgttcaaattattctcactttatctaacatttcgctaataaataaacaaaccttggggaagttaaaaaaactgaggattcgaattttcgaaatactatcaaataaaaacgatagttggaaatctacattactacagaaaaaccttatagaatggtacatttttatgctttccgtggattgcacacctttagaattgcaaaacttatatctccataaggagttgaaattctgtaacgatatcttgaattcattaacactccaagtttctgatcctcgctcacaaaattacctgcaatttgagaacacgtataagctttttcaaatacaaaagtcatctagaattaacaactcgttccttttttacatagaattcaattccgttacctcaaataggataatgaccatagaaaaacacatttatttggaaattaaggaaggccagttttgtatttcaaatgataactacataatcggtttatttgaaaacttcgaattcgaagcgggcactttgtactttattggagttttaattgatcacaataatcgaataactctttatgttgatggaagtatgatcaatcagctcacgttatttgaaaactctatatgccaattaagcacttgtgaactgggatccatgatttgttcaattaaagtatatagattttatttgtgggatggattattaacagaatttgcgataaatatacttcaagctatcggcaccaattaccaatatacatttagcaagaaaaaagaagggcctgaagttttatcgctctgccaagactttttgatcgctaaggctcatttaatggccaggcctgcaacagaaatatcttccacaaaatacatcgatgagattgaacttcttgaaatggaaaatatcattattgatgttaacccaaatgatattcttcaagatttcaccgaatcgtctaattttacggtaaaatttgaggaaagcacaaactcgaaaaatattccggaagtgggtaagtgctatttctataggagttcaaacttggtttcaaaatttgtgtccattgattctatacggcttgcgtttttaaacatgacagaatccggtagtatagacgatctgtttcatcatgtatcacatctgatgaatcttttacgaaatattgatattcttaattggtttaaaaaagactttggcttccctttatttgcttatactttaaaacaaaaaataacacaagatttatctcagcctctgaatatccaatttttcaatttattcttagaattttgcgggtgggatttcaacgatatttccaaatccataattctagatactgatgcctacgaaaacatagtccttaacttggatttatggtatatgaatgaggatcaaagttctctggcgtcaggcggattagaaattatcagatttcttttcttccaaatttcaagtttgatggaagcctctatttattctaagttcaattccaataaattcaatgatatgaatatcctagaaaaactatgtttaagctatcaggctgtcacaaaaagagaaaatcagaacagtaaatttaatgagctatcaaatgatttaatttctgtatttgttactttattgaaaagcaatactgataaacgacacctgcagtggtttttacatctctcatattactttattaagagaaaagatgtacgttctacagaaattatacttcaagcggtagatcaacttttttcgttttacttagatcaaggtagcgacgaaaatgcgaagatactttcagagattataccacttaagctaatgctgatgattatggatcaaatagtggaaaataatgaatcaaaccctattacgtgcttgaatatcttatttaaggtagttctgaccaataaaccgcttttcaaacaattttacaaaaatgatggtttgaaactcatattgactatgctttgtaaggtagggaaaagctatcgagaggagattatttctttgcttctcacatattctattggcaattataccacagctaacgaaatattttcaggtgctgaagacatgattggaggaatttcaaacgacaagataactgcaaaagaaattatttatttggctgtcaacttcattgagtggcatgtgattaattctaatgccagtgattcttcttctgtattggacctgaacaaccatatattaagattcgtcgaagatctgaaatcgctgagcgctgttccgattaatgaatctgtatttgatcctaaaaaaagttatgtgatggtttcattattagatctctcgatagctttgaatgaatcggaggacatctcaaagttcaagagctcttcaaaagtgatttcagagctcattaaaggtaatataatgtgtgctcttacgaaatatgccgcttatgatttcgaagtctatatgagcacatttttttgtcacagtacagaatacaaactggtttatccaaaaactgtaatgaacaattccagttacttagagctatcatttatagtgacactcctacccgaaatacttaatgacctgatagatagcaataacaatttgaacctgatgatgttgaagcatccatacacgatgtcaaatctcctttattttcttcgcaaatttcgacctgatacgtcacagatagttatgcctaaagatttttatttctcaagttatacatgtctcttgcattgtgttattcagattgataaatcatcattttaccatttcaaaaacgtttctaagtcgcaactgttacaggaattcaaaatctgcataatgaacttaatatattccaatactctaaagcagataatctgggagaaagaagaatacgagatgttttctgagtcactgatggcgcatcaggaagttttatttgcacatggagcatgtgataatgagaccgttggcttattgttaatattttttgccaacagattacgtgattgtggatacaacaaagcagtcttcaattgtatgaaagtgatcattaagaacaaggaaaggaaactaaaggaggtggcgtgtttttttgacgcagcgaataaaagtgaagtactcgaaggtttaagtaatatcctctcatgcaataactctgaaacaatgaacctcataactgaacaatacccattttttttcaacaatacacaacaggtacggttcataaacattgtcaccaatatcttgtttaagaacaacaatttttctccaataagcgttagacagatcaaaaaccaagtttacgaatggaaaaatgcaagatcagaatacgtcacccaaaacaataaaaagtgccttattttatttagaaaagacaacacatccttagattttaaaatcaaaaagtccatatcaagatacacttacaacctcaaaacggatagagaagaaaatgcagttttctatcgaaataatttaaatcttttgatttttcatctgaaacatacactggagatacaatcaaatccaaattcgtcctgcaagtggtcattggactttgcagaagattttgatgggatgaaacggaggcttttgcctgcttgggaaccaaaatatgaaccactcattaacgaggaagatgctaatcaagatactataacaggtggtaacagacaaaggagagaaagtggaagcattttatcctacgaatttatcgaacatatggagactcttgagtcggagccagttggagatttgaatgagaatagaaaaattcttagacttttgaaggataacgattctattgcaactatttggaattgcagtttgattattggattagaaattaaggaggggattttaattcatggcagtaattacctttactttgtaagtgattactattttagtttagaggataaaaagattctaaaattatcagaagtatcgcaagaatcacgggatatgacggttagcttaattaacggccctgatgttaaaagggtatcaactttcctaaagcacgaagtctttgtttggaaacttctcgatatcactttcgttaccaaacgaccctttctacttcgggatgtcgccatcgaattattgttcaaagagagagttagcgctttttttagtttttacaacaaaagagtgagagatgacgttttacgggtactgaataagatcccgaagcaccttccagcagatccaattttttcaagcgttttacaagaaataaacgaccgaggaaatagtatagtggcaagaaatggaataggaaaggcaagcattgcttccaaattcactagcgtcttctcagcgaacaacagcctaatagatggatttgagatcagcaaaaaatgggttaggggagagatttctaatttttattacctgttgagtatcaacatcctagcgggaaggtcattcaacgatttgacccaatatccagtgtttccgtgggttattgcagattacgaaagtaacgtactcgatttagagaatcctaaaacttaccgggacctatcgaaacctatgggcgctcaaagtgagaaaaggaaattacagtttatagagcgttatgaagctttggcttccctggaaaatgctgattccgcaccatttcattatggcacgcattattcctcagctatgatagtatcttcatatctgataaggctgaagccctttgtcgaatcctttttgttattgcaaggcggaagttttggccctgcagatcgtttatttagttcgcttgaaagggcctggagctctgcttcttctgaaaatacaacggatgtcagggaattgacacctgaatttttttttctacctgaatttttgatcaacgttaatagttatgactttggtacagaccaaagcggtaaaaaagttgacgacgtcgtacttccaccctgggcaaatggtgacccaaaggttttcattcaaaagaatagagaagctttagaaagtccttatgtatcagcacatttacatgaatggattgatttgatatttggttacaaacaaaagggggaaattgctgtgaaatctgttaacgtattcaacagattgagttacccaggcgctgtaaatctagataatattgacgatgaaaatgagcgcagagctatcacaggcattattcacaactttggtcaaacgcctttacaaatatttcaggaacctcatccggaaaaaatagcctgcaatgttcaacagctaacaacagaggtatggcgtaaggttccaatgaagccaatatttgagaagacaatctttaatttgaatgaaaagaacaggtctgtcgattatgttatacacgatcctagttacttcgattcattatactggaggggcttcgctttcccaaacttgtttttcagaacggaagaatcgttagtgtcattgagaattgtgcataaaaattggttaaaaattggactagatatttttaaaaagacgcatatggctcagattacatcgtttgcgtactggaagttgggcgaattcataactggtgataaaaatgggctgataaaagtttggaaatatcgtaaagataagcattcggtttcaggtaaccttgagaacaaaaaaacaatgtttgggcacctatgcgagctaaaggaaatgcgctgttatcacgactacaatacgcttttaaccttagacatcagcggcttagtatatgtctgggacatgattaatttcgaactagtgagacaaataacaaatgatgcgcaaaaggtcgcaatatctcaacatgcagggagcattatggtattgactaagaataacgccatttcgatcttcaatctaaatggacaaatatatacatcaaagaaattcgaaccagctaaaattgtaagctcaattgatttttttgacttcactaagttagacgcaggttacagaaagcatatctattggaaagagatggaaatactactagtgggctttgaagatggaactatagaaatttacgagctctttttgacttttcataatgaatgggcgataaagctactgaaacagctctgtaccgaaagagggaaagccataactagcattaagggacaggggaagacatacctgtcccagaaaagacgcaaggatacagcagagcctcatgagatagaagtgattgcgggaacattagatggcagattagctatttggtactaggcatgacatcgtaacgcctttctttaaatgattcaatttttgtagtttatatctttacttttgaaactgatttctcatcccacctagtattgtaattgcgtacgtatccaatatcattaccaacgccgggtatttttttctagtatttcttctccatttcgcctatggaaaacagcaaaagggtaaaagaaaaaaacaaacgattaattcttcattgaattatgtaaaaatcaaaacgcaaccgcagatttaatagagaccagaaattcggattactattgactttgtgcaccaccttcaaatttactcattgtttaagacaggcagtgggaaagaagccgtcatattgctcgaatccttaacaagcaaaatatacaaccactaaattattccgaaagggcctgcttaataatttgcctactaacttgtgcatagaacagcaaacagaaacaaagcgtaagaaacatggggtatccgccacctacacgaaggcttggagataagaaaaggtaccattattccaataatcctaaccgaaggcatccttccgctgtttattccaagaatagctttccaaaatcaagcaataatggatttgtatcttctcctactgccgataattcaacaaatccgtctgtaactcccagtactgcatctgtacctcttcctacagcggcacctggaagcacgtttggtatcgaagcacccaggccatctcgatatgatccgagctcagtcagtaggccttcgtcatcatcttattcgtcaacaagaaaaattggaagccgttataacccagatgtggaaagatcctcttcaaccactagttcaactccggaaagtatgaatacgagcaccataacacacaccaatacggatatcggaaactcacgctattctcgaaaaaccatgagcagatataatcctcaatctactagttctacaaacgttacccactttccctcggcattatcaaacgctccaccgttttatgttgccaacgggagttctcggagacctcgatcaatggatgattatagtcctgatgtaacgaacaagctcgaaacaaataatgtttcatctgttaataataacagccctcattcttattactctaggagcaacaaatggagatccattggaacgccttccagaccaccatttgataatcatgtcggcaatatgacgaccaccagcaatactaactcgatccatcaaagggaacctttttggaaagcaaatagtactactattttaaaatcaactcattcacagtcatcgccttcccttcatactaaaaaatttcacgatgcgaataaattggacaaaccagaggcttcagttaaagttgaaacacccagtaaagatgagacaaaaaccatatcgtaccatgataacaattttccaccaagaaaatcagtttctaaacctaatgcacctttagaacccgataatatcaaggttggcgaagaagatgcattggggaaaaaagaagtacataaaagtgggcgtgagatagcaaaggaacatcctactcctgtaaaaatgaaagagcatgatgaactagaagctcgcgctaaaaaagtaaataaaatcaatattgatggaaagcaggacgaaatttggacgacagcaaaaacagtggccagtgcagtcgaagtttccaaagaaagtcataaggaactaacacgctctgttgaaaggaaggaaagtccagaaattagagattatgaaagagcatacgatccgaaagccctgaaaacagacgcaacaaagttgacagtagacgatgataataaaagttacgaagaacctcttgaaaaagtggaagggtgtattttcccattaccaaaagcagaaacgagattatgggaattgaaaaaccagaaaagaaacaaaataataagtaaacaaaagtacttactgaaaaaggcaattaggaatttctcagagtatcctttttacgcacagaacaaacttatacatcagcaggctaccggacttatcttgacgaaaattatatcaaagataaaaaaggaggaacatttgaaaaaaataaatttaaaacatgattatttcgatctccagaagaagtatgaaaaagaatgcgaaattttgactaaactgagtgaaaatttaaggaaggaagaaatcgaaaataaacgtaaagagcacgaattaatggagcagaaaagacgtgaagaaggtatcgaaacagaaaaagaaaaaagcttacggcatccatcctcgtcttcctcatctcgtcgcagaaatagggctgacttcgttgatgatgcggaaatggaaaatgtattgctacaaatcgacccaaattataaacattatcaggctgctgcaacaattcctccgctaattttagatccaatccgcaaatactcttacaaattctgtgatgtaaataacttggttacagacaaaaagctttgggcgtctagaatattgaaagacgcctctgacaactttactgaccatgagcactctttatttttggagggttatttaattcatcctaaaaaattcggtaaaatttctcactacatgggcggcttaagaagtcctgaagagtgtgtcctacattattatagaacaaagaaaactgtgaattataaacaacttcttatcgataagaacaagaaaagaaaaatgtcagccgctgcgaagcgccgcaagaggaaggaaagaagtaatgacgaggaagtcgaagttgatgagagtaaagaagagtcaacgaacacgatagataaggaagaaaaaagtgagaacaatgccgaggaaaatgttcagccggttctagttcaaggttctgaagtgaaaggtgatccattaggtacaccggaaaaagttgaaaatatgattgaaaagagaggcgaagagtttgcaggtgaattggaaaatgctgagagggtaaatgacttaaaaagggcgcatgatgaaattggagaagagagcaataagtccagtgtaatagaaaccaacaatgaggtacaaataatggctccaaaaggaggtgttcggaatggttattatccagaggagaccaaagaacttgacttcagtttagagaatgcgttacagagaaagaaacacaaatctgcaccagagcataaaacaagttattggagtgttcgtgaatctcaactctttccagaattgttgaaggagtttggctctcaatggtctctcatatcagaaaaactgggtaccaaatctactacaatggtaaggaattactaccaaagaaatgcagctcgcaatggatggaaattactggttgatgaaaccgacttaaagcgagatgggactagttcagaatctgtacaacaatctcaaattttgatacaaccagaacgaccaaacatcaatgcctatagtaatattcctcctcaacaaagaccggctttgggttattttgttggacaaccaactcatgggcataatacatctatttcatctatcgatggctctataagaccatttgggcctgattttcatcgtgataccttttctaaaattagtgctcctttaaccactttaccaccaccaagactaccatctattcagtttcctcgttcagaaatggcagaacctacagtgacagatttgcgtaacaggcccttagaccatattgacacgttggctgatgcagcttcgtcagtaacaaataatcaaaacttcagtaatgaaaggaatgcaattgacattggccgtaaatcgacgacaatcagcaatctattgaataattcggatcgaagcatgaaatcttctttccaaagcgcttcaagacacgaagcacagctcgaagacactcccagcatgaacaatattgtagtacaagaaataaaaccgaatattactacgccaagatcgagttctatttctgcattactaaatcctgtaaatgggaatgggcaatcaaacccagatggaaggccgttgctgccatttcagcatgctatttctcaaggcactcctactttccctttaccggcccctcgcactagtccaataagtcgtgcgcctccaaagttcaatttttcgaatgatccgttggcagctttggctgcggttgcctccgcgccagatgcaatgagcagttttttatctaaaaaggaaaataataattgaacaaacggctgagacgggcaatacatatgctctacttcttttccatccaatggttggtgaaactctcgagcatacattaccttacgtgtgttagtgtactatattatatatatatatatgtatatatataaagggaggagtttttaattataattgtaatttcgtattttttctgcattatacagttttttccgattttaaacgactttatttaagtgtcgtgtaaatatgtcacattttatttttgtacgtattcacatgtcctggcgtgcggccattgctgaaaatcgcaaaacccacagagaaataaacatcgcgaaaaagtcaatgaaaaattggaaaatatttttcatttcactattatccacaagcaattttgtacaaagtgaaaaggttgaactaattatcttcgtctagaagccatgaattcactcgttactcaatatgctgctccgttgttcgagcgttatccccaacttcatgactatttaccaactttggagcgaccattttttaatatttcgttgtgggaacatttcgatgatgtcgtcactcgtgtaactaacggtagatttgttccaagcgaattccaattcattgcaggtgaattaccattaagcactttgccccctgtgctatacgccatcactgcctattacgttattatttttggtggcaggtttttgttaagtaagtcgaaaccatttaaattaaatggccttttccaattgcataatttggttttaacttcactttcattgacgcttttattgcttatggttgaacaattagtgccaattattgttcagcacgggttatacttcgctatctgtaatattggtgcttggactcaaccgctcgttacattatattacatgaattacattgtcaagtttattgaatttatagacacctttttcttggtgctaaaacataaaaaattgacatttttgcatacttatcaccatggcgctactgccttattatgttacacccaattgatgggcaccacatctatttcttgggtccctatttcattgaaccttggtgttcacgtggttatgtattggtactatttcttggctgccagaggcatcagggtctggtggaaggaatgggttaccagatttcaaattatccaatttgttttggatatcggtttcatatattttgctgtctaccaaaaagcagttcacttgtatttcccaattttgccacattgtggtgactgtgtgggttcaacaactgccacctttgcaggttgtgccattatttcttcatatttggtactatttatttcattttacattaacgtttataaacgtaaaggcaccaaaaccagtagagtggtaaagcgtgcccacggcggtgttgccgcaaaggttaatgagtatgttaacgttgacttgaaaaacgttcctactccatctccatcaccaaaacctcaacacagaagaaaaaggtaagtgtaaaatctttgaaagaatttaagtattcaactttcgtatattcgttttttcttagtggatctattgttactattatcactattattatattgtaaaagaccggatggttttgttatatattacatacacatgttatcgttgaaaaaagttttccgtttcctttcgacagtcatcagataattttatccgagtcttttatatgttaaatcttgttgacaaatcgtccgctctaaccctagataacaacaatgatctttttatcatttctggcgttattttagcgcctcctcccattaatgttaattgcttatagttacctgaaggagcagcgaggatggagatcgtactgtgtatacttgtttcttccgcttcagtatctaggtctgctattagcacagtgttcaatttatccatatcaatgtccacttcctcttcttcagagttatcagagttttgtaattggcattcggggtctaactccactatcccataatttgaagcaaatgcaatattctttgcgtttatcattaacggtactgacttagtttggtcgcaaataatttcatacgtttctcttatggtggcacttcttcctcttgttcttatagtcattcttaaatcggacgcacgctcatctataaatgctctaggtaactttacgctctgtaaagcgtacatcaaagaattccaacacaaatcgaagactggaccagtgcgactcaagactacaattttcgcatacaaaacgtatgaccattttcttttcattttcaggtttgtttcattcagcgtatcatcttctaattcatcgggatacaagacggaaaacgtaccgtcttcattcgcactacgaacaccagcttttaccttcaaggcttttttaggcaatatcctagagtgcaatatggaatcgtgtagtttttgtgatatagtcatttcttcatcggtgcaagcgcccactctacctctttcaacttccaccaccggatagacagaagcataatttgcaattatgtcctcctctttggtcacttcgaacaattcttcctcaccgaaatcatccaaatctttaatcgaggcgctagtttcttctattattccacccgtaatagaagttatgactatggttttcccacttttcaaaacatttgagcctaaaatgttgtttttagtgtctatattaccagcatccgcataacgcgataaagtattattttctatagcaacatctctaaattcttcatattttcttagacatggcctgattcctagggataagtgtctttgtaaagacaattctggagatattctcgcaagaacttcaggtggaaaagtaattgggtgtatctcaatagtttctaacgtggtactttcagccatttccaatattagatgcctgtgaaactactgtcaaacttatttgtgtagcaatactcatcgtctaatttgtccattattgttatatactatgtcataaaaaaagaaagaaaaatcttatactttcgtcgactgtgatttgaaaatctctccagatcaaacgggaataaaagggtttatatccgaaggtggccagaacaatcatgaagcaaataggataaaaatagccaataagatgtttgttgtctttcatcccaaagttccaacagcatatttcaaagatgggtattacagtaataggttctctaaactatgatttggacacatttacggatagattacctaacgctggagaaactttcagggctaaccacttcgaaacacatgctggtggtaagggattgaaccaagctgcggccattggtaaattaaaaaaccccagcagcagatatagtgttcgaatgattggtaatgttggaaatgatacatttggtaaacaattgaaggacactttatccgattgcggagtcgatatcactcacgtcggtacttacgaaggcattaatacgggtaccgctaccatattaattgaagagaaagctggtggccaaaataggatattgattgtagaaggtgctaacagcaagactatttatgacccgaaacagttgtgtgaaatttttccagagggcaaggaggaagaagagtatgttgtttttcaacacgaaattcctgatcctctttccattattaaatggatacatgcgaacaggccgaattttcagatcgtatataacccctcacctttcaagaccatgcctaagaaagattgggagttggtagaccttttggtcgttaatgaaattgagggtcttcaaatcgtggaaagtgtatttgataatgaacttgttgaagaaataagggagaagataaaggacgactttttaggagaatatcgtaaaatttgtgagcttttgtatgaaaaactcatgaatcgaaagaaaagaggaattgtggttatgactttgggttcgagaggggtgcttttctgttcgcacgaaagccctgaagtacaattccttccggctattcaaaatgtttcggttgttgatactacaggagctggagatactttcctgggcggtttggttactcaattgtatcaaggagagaccttgtctatggctataaagttctctacattagctagttcattgaccattcaaagaaaaggtgctgctgaaagcatgccactgtataaagatgttcagaaagatgcataaaatctactgcaattttttacttttagtttgttaaattttagttttcgtcatatatataaagtttaaaaaggtacaaagaatgcagtaataagaaatgtaattacatgagggcagtttaagtgctaccttttaagacggaagaactaataccataaccgagagtaattacgcagacaaacgctaacaacgaagcaggaacacctctggagataaaagcgcctacagttagccatctattaccctttttatcggtcatagaaatagcagtaacgtttggaaatccagatgaagccaaccccataccgcatgaggctaacaaggcgcaaccgaacacaagaattggagctgcctttggatcggataatttgtcaccaacttcttgcaccaagggaataatgatgattgctgacacagtatgtgagacaaaagtgcccacaactaacattaaaataccgaaaatacataagatagcaaaaacaccatcgttctgaattttcttttgtaatgctcttgcaatagttaccaacaagcctgaagatgaaactgccttaccaagggctataccacccatagcaagaacaacaattgaccaagggaatgtgttgaaatcctttgttgatagtagacctgtaccaaaaaacaggactatcggtattactgcaatttcaccggacgatccaaaagcactttctatttgtgactctacacaccatagaagaatagtagcaatagttacaatgatgataaaatattgctttatagtaaatctggtccttattggtttaaatttttccagtttagttttgcctattttaaaggtgagtatcatcaaggcccaggagcacagcatcgatagaatacctgtaggcagagcgacagcaaaaaattgcccccagccgattccataaggttttaagtactgcatggagatgatattctgtggcgaagaaataggtgaagccataccaccaatatctgccgaaagtgcaacacccatgactaatgccttagcaaacggtgaagtgtagtccagcggatctagtaagggtgttaatagagaatatgtcaatactggggaggcaacgttggaaatccacatcgaaagaaagaatacaacactcattgccattaaaaggacatttcttggcttggtacctgcaagggccaataaccacgatgccaaaactttcgcaacgttatattgcgacaaggcttcacccaatgtgaaacctgctaataaaatcataattgttgacgaccacattgtacctaagatttctgtagaggcagctgctgctcccattaccttaccgtcatcgtcttttagtaccctaaaaaggacagttagaaggggaaccaataaacctgtgatgtgtaatggaatggcttcactagcccataagaaagcacagcattctaccaatgccatacaccggtgttcgacagggtcattgaaagttttaacacccaacaaaacacctgtgacaatgataatgaagcctattttcattgctcttttcccaaaaaatagcttaggaactgccaaattttcaattttagtaaacttcaaattaattggcttaggcaatggatacttgaaatattcaatttgaagcttttcttgcataagtttctcagcttcatcttcaatagttattatatcgttattttgcgaagagaggcccaacatgtctttccatgtgttgcttctttcccaaacaatgtggtcgtgcaggtacgactttaactcttgcttgcatgaatctacgttcccaggctgacccatgagaacagcataaaattcaataagttgtgcaattttactgtttaaactgcttaaagtttcatgctggaagatgtaggtgtctttgaaaaattcttcactttctattaattcttgcctagtgttcatgtgcaatactttatcagacttcttagtaattttactgaaacccattctgttcaattcgataaaagatttcaactggcaaaggtctatgtaaagatttattattgtctgttttaataatgattttttctgagatttaatgttaaattgcgaataattcaagagggcggtattgtcggtagtgtcagcaaacacgtcaacgtcatcatcttcatccatttcttcttcgctgtaatcaaacctatttctcaattcactgtcgatgtttgaagagtgtatttcaaatgggttattagatgaatgtgtctctgatgtaccagaaataatttctcttaaaggaggcaatgcttgaatttcaggattgaaagtttcattcaatcttgttacaatgccttccttctccaaatcattaatcaagtggtcaaatctttcatagaacttagcttccattcttttgtagaaatcatctactttcaatttctcgtcgctcaggttagttacgaatgtatcataagaactgaagagcgtctttccctcgctactcacagatgagctgcgtgattcaaagaatttcttacgtataaaattcttattgaaagaggtggttttcccttgaggagataactcgtctaactcaattgtttcctcgttaatattgttcccatctatggccttttcgtcggagtctccccttttgcttcctgaaggtgttttagaaccaaagagcttacgcttgagtttatgtgtaaatcttcttttcgatggagatggttctcctgcagctatgttgctttctatatcagcgattggacctggagtctgagagtcagcgtcatcgtttaagtcaccggttggcgtttcttgtttcaattcatctgtctgtaatgtgtagatcaaatttttcaattcgttataatctaggtaatgattctgccattcagggacagcgttgtatttgagaaagtgtgagaatctcatttcgaggcacaataatagccgcctttaccgtagttttgctgcacctttatctgagagctgactgcttttttggtgtgaaacactgttttctggtaataatttttcaatgcatcggattacctttcccacgtgcgaaatcatcaattaattagattgaaaaaagggtaagggaaaataagaaagaggcggtagcctaaagatacggtaattgaaacgtttcctatgcacaatcttaaacctttttaggtaattgattaagttgactgtaatatctgtaaaagattacatctaatttacgtctggtttcttatcaaaaaatattatctactgtagttatgcaagtattcttaactttcagtactaaacatgaatattaattatttgtgagcgtacaagaagcaaaaggaagtcatctttctttgaacagttctgtttttaggtaagccttggaaccttagctatactgacttgatacgccctgtctttgttgtcgttatataaagtgtgcacctttatcatagcccctaataagcttcttgcagtagtatttgaacagtgtatatcttcatattgcttttgttgtaaatattgcgcaaaagcgactatctttgtgatttggttgaacttttgcatattcacgttattaccatctttagtgaatgtatcgtttccgtctcttatgaaggtaatgtccctgataagcagtgatgtaaaaggtacacaaggaagctgactgtggaaaatatgtttaattgttcttctataaacgttgtagttgttgtttggatgtacgacgacttttaggcgctgaaaaaggtggtctgatttaacatctatcgggagagatagtctttctattgaatgattttgcaatgatgtaatgattgaagcaagtgagtttaagtttcgtaagtatagacaagcaagtgcaacttgtaaccagtaggaaatggtgtgcgtttgctgcaaagttgtctcaagaacgtaggacgataactggttggaaagcgtaaacacggagtcaattgttgtatcgttgtgtttgaaatgtcttgtgaattctattgtttcaatatccaagtaaagagaagattctaagagagtcaatgtctttgcaagtgaccatggagatacgtttagagcgaaggcttcgacttctagaggttcaccctgtttccattggaaaagtaaatcactgaggtcagttgcaccgcacaattcatcatttgcgttcgttttgtctatctcgtattggagaaataagttttcgtagtccaggggcggtttattttcttcgatttccttatcagttagaccaatgtaatgaatcttcaattgcctcgttctttttttgtttataaacagctgaactatgtctgcaaacagttcttggtattcataatattcagccaagtgactgtaccaaaaattgaggatatcttttaatgttgtctcactatcttgccaataagactctacccagatttgtattagacgagggacggagtgatttttgtgtttgtttttattaattgtgggataggatagtagcaactcttggaggagagcattgtcagttgtccagtctctgaagttaagtagtaagtttgcggagtcaaagggggatggcttttgccatttgtgagagttgtgcggcagcatcttattcaaatagagctgtattctgaagacctcttgtagaacatcatccatactaaaaagtaaatcgtcctgtcccattacgagctgtattagtgctgtgaccctctgtatatttacgttgccatgaagaaggtaatgggcgatattttgatacaattcctgagttgcatgttggattgagtttacgaagggtcgccagacggccagaaacctccaggcggagttaacaactaataatacggcatccatgtttgcatcagcgccgagcctataccagtcactgagtagacgttttcttgctctttttatgtcctgacttcttttgacgagggggcattctctagagacacaggcagttgcttccagcaactgcggtacggccgttctcatgctgtcgaggattttttttgggacgatattgtcattatagggcagtgtgtgacttatgaattgttgtagaaggacgtctgtgatgttggagatatgtattttgttaactcttcttgagacgatttggccctggatagcgaagcgtgcggttacaaataggtcgtcttgttcaagaaggtaggcgaggacattatctatcagttacaaacatcttagtagtgtctgaggagagggttgattgtttatgtatttttgcgaaatatatatatatatattctacacagatatatacatatttgtttttcgggctcattctttcttctttgccagaggctcaccgctcaagaggtccgctaattctggagcgattgttattgttttttcttttcttcttctattcgaaacccagtttttgatttgaatgcgagataaactggtattcttcattagattctctaggcccttggtatctagatatgggttctcgatgttctttgcaaaccaactttctagtattcggacattttcttttgtaaaccggtgtcctctgtaaggtttagtacttttgtttatcatatcttgagttaccacattaaataccaacccatccgccgatttatttttctgtgtaagttgataattacttctatcgttttctatgctgcgcatttctttgagtaatacagtaatggtagtagtgagttgagatgttgtttgcaacaacttcttctcctcatcactaatcttacggtttttgttggccctagataagaatcctaatatatcccttaattcaacttcttcttctgttgttacactctctggtaacttaggtaaattacagcaaatagaaaagagctttttatttatgtctagtatgctggatttaaactcatctgtgatttgtggatttaaaaggtctttaatgggtattttattcattttttcttgcttatcttcctttttttcttgcccacttctaagctgatttcaatctctcctttatatatatttttaagttccaacattttatgtttcaaaacattaatgatgtctgggttttgtttgggatgcaatttattgcttcccaatgtagaaaagtacatcatatgaaacaacttaaactcttaactacttcttttaaccttcactttttatgaaatgtatcaaccatatataataacttaatagacgacattcacaatatgtttacttcgaagcctgctttcaaaattaagaacaaagcatccaaatcatacagaaacacagcggtttcaaaaaagctgaaagaaaaacgtctagctgagcatgtgaggccaagctgcttcaatattattcgaccactcaagaaagatatccagattcctgttccttcctctcgatttttaaataaaatccaaattcacaggatagcgtctggaagtcaaaatactcagtttcgacagttcaataagacatctataaaatcttcaaagaaatatttaaactcatttatggcttttagagcatattactcacagtttggctccggtgtaaaacaaaatgtcttgtcttctctgctcgctgaagaatggcacgcggacaaaatgcagcacggaatatgggactacttcgcgcaacagtataattttataaaccctggttttggttttgtagagtggttgacgaataattatgctgaagtacgtggtgacggatattgggaagatgtgtttgtacatttggccttatagagtgtggtcgtggcggaggttgtttatctttcgagtactgaatgttgtcagtatagctatcctatttgaaactccccatcgtcttgctcttgttcccaatgtttgtttatacactcatatggctatacccttatctacttgcctcttttgtttatgtctatgtatttgtataaaatatgatattactcagactcaagcaaacaatcaattcttagcatcattctttgttcttatcttaaccataaacgatcttgatgtgacttttgtaatttgaacgaattggctatacgggacggatgacaaatgcaccattactctaggttgttgttggatcttaacaaaccgtaaaggtaaactgcccatgcggttcacatgacttttgactttcctttgtttgctagttaccttcggcttcacaatttgtttttccacttttctaacaggtttatcacctttcaaacttatctttatcttattcgccttcttgggtgcctccacagtagaggttacttcctttttaatatgtacttttaggatactttcacgctttataacaatatcaagtttaccttcttcattactattcatcttcgccacaagtcttctctcccttggtgtttccaatctaactacaaaactgttgattagggtgtacatcaccctaacaagatcatgtatttgcttcctctggtacaagctaagaacaggtaaattcaaaacatcccagagtaatatcttcaaagggctataccctttaaacatatctcggcatatttgtattaacccactaatattttgacggccaatcttttctatttttattttcatatcatcgacgtaatgaccacttaaaaacaactcaatatcatcctcactttttatatttttaacttcattgtgcacagattggacggaggacttaatatcgtcacttatggtatccaaactaccatccataacaactagatttacacattcagaaagcacatcaacacttttatccctaatataagaatcctcatggaagcaaagtatttcagtaaacaaaacaagggcatccttgttttttaaaccaccttctaaaagcatgattttcaaaaccattaaaaactcattctgaaagctttccctggaaatatctccgttatttatacctaatgttaatgtatgcattatcattcctgtcaattccgtaaagtcataagcacccactttatgcaatttgtacttagcatacatgatagtagtcttaatcaaagactcgtatgatgaaagccaattcaccaaattttcgtacctcaataactgagtcttaactttttccatatatgctttatctttatactcatttaaagcaactttaacaacattttcaatcaagctgcggacgtacgcatcatcactgtatttattttcaccattctcattataaacaagaatatccagtaaaaattgcttcaccaattttggacatttaccattttcatttttcactttagccaaatatttgggaatattacactgtaagaaatacaacttaggattctcaaagttattactctttggaatattagagtcttctaggcaaaacaaaatctgaaaaatctgaattaaatgcttaacaccgccagtaaaatccggatcatatacgtatttactaagcgcttcgcacgccgcgagtcttatgccaaaaaagtaacgctcgtcgatcgccgttctaaacaaaatacttgaataaacaagtgatttcacaccaccattaacaacgacgtcctcataatatcgtatggcttctagttgggcctctatgtccccatcttgtctcaactgagaagaaaacatgtaatccggctgattaatgtgcatttggcaaatccattccagatcagagtctatgcgtatccactcaaatgcttcgttttgcttaagcaattcattactctcagacgtacgattaaattccgtcaaactgaatcgggaacactcttcgggcgacatgtatacatttcctagacaattcacatccacaacaataggcttctcctcattattgttttcaacaccattttcatcatttgcaccaccacctcttttccttaatcttctgtactttgtattgtactgaatatctatttttgtgaatgtatctttgatttccacaatatgctcatacggagtaccatcgtgttcatggatccttatagtcatcgagcccgtgaagcattcggttcggttcaaatctggatgttctaagtggtctagtgcacttttgaaaaatccttcctcccctaccactttttcgtggccaagttcttcatcttgaacttgccttatacccagttctataaccatcctcttcctattaaatctttgggtgacacgtaatatgggtaccccagacccatatacccattcgttgaaaaaattctctaatttacttttattaactctttcgcaaacatgttgaaaatgcgatgaagtcaacgaattattcggtaaatcaccagacatagcttgaaggaaaattttaggtaatactcgagacataccgaaagatcgttctgttttagtcatccttctgtcaagtatgtgtagtatcatcggtgccttcaattgtataaaggacaaatctttagaagaccaagatattggcctagaactgccggtaaaagtgctcccaataggcggtttctcgaagtcttgttccacaatcgcctcactattacgctttaattgatatttatacgtgttattacccattaattttttggttacctgaaacaccatataaccagcaataccaagacagcaccagtagtcgttcatatctaaaggagttatattcacacaagaccattggttagcaagtgcccatgctaactcattcgtagtactgaatgctttatcaataacttctagagggtacaataatctggtattacaaatgcctaatgctgcaaaatccatatgcttagaaggtgcggtaggtaaaaacaccatagagtaacaagtgaaaggataagacccaaattctttcgagtagaaatctataattttttggcagacaactgtcgaatttataactgttaactcatctgtttcctgcgtcggaagtgtgaaaatttgaatgggtataatatccgaaccaatgtcgtcatccatagtatcgttaacattgtccacaacattctctctcaacttgtcttcctctacttcgtcctcggcatcaacacttggaggtgatatcaaaggtaaagaccatgaattaaaggcgcctatagcccaaccaatgtgatgtggagccacaggattaattatctgaaatatgcatttttttttcgtcaaatcaatcgggtgcggaagttctttaatatttgaatattctgaacaacacacaatcacatccctcaaactcggattgttgctttcctcaatattccgcctttcctcttccccttcctcttcctcttcgtcactttcgccttcctcttcttcttcatcattatcttgtgcatctttgcttttactatttttgccttcttcgtcatttttcaagttagaatccttatcttcgtctttgataactcttgccggcttcccctcttcctcttcatcgtgctcaggcgtatcctccttctctttttcactctcttctccattttgtccgattaatttcgaagtacctatatttttaaccaatctcggtacgctgaattctaactcccatgtagatttttcatcaagcaaatcgacacatgggacccaatatgatgcagaactgcaaatctcaccatttgaagtgtaaacgttccataaccagggcttgtcagcatacacagtatcgaatttaatacccgactttgggtttctgatttcatattcaatttgtaatgtaattggagtgaaaacagattcttgaaacccaggggtagtcttaattgaaggagtaatcggagtgtaattacttaatgcattggcgtcctccaaagatattttgatggaagatggtatttttatagttaactgggatttagagtccgtttctgggtattcattcaagctagcaaacttagatctcaaaaaatgtgactgttcaatggaattgtcgctgtataatacattttgtgaagtcaatccattcaaatttgtttgaagtgggtcgtcatgaataaattgatcacatcgacgattttcgaccagaacatctttaatagtcatttccttgcaatcaaaagttacatattctaggttttggatcaacggaatgattattatagtagcgctaccggtaatgcagtgagtagctagatctatatccaacgagattttttcatgggcaactctaaaatttctaaacttcatctcatgcaaagtgctagattcactaacaatggctctaggagtggcgtttttggaaaaggacatcatgaagtccacctatttatcctgttgtcacctcttcactgtccaaaacttcatcaaaaaatacttttacatccgttccattttactatagttttcatcttacgcaatttaccaattgccccattcggcaaaagtatttaagtgttacccggttacttaaggtaataccaaaaatattcactatattgaaagttctatgtattttattgaattaaataagacttgattttgtagcacgatatccgcaagaatgattcacaaccattttagatgtctgcagcttttttttttttgatttttttactaattttagtgcgattttagaataactcttggattaaataaataaaaaaaatacaattatcactcagattttgaagcaatctgataaaaattgcagcatattattataacaattctagttcactacaaacagcacattatcaagaaacttatgtttgatggacagtttcttcaaataattgaatgcagtaaaaaataaaaaaaataaccatggaatatgtttctaagaattcgcaatccttgtttatataactatagctttttttatgttataagaaaacatttattcctttaaccaaaaggaaaaaggtaacaaccccacttacccctctgtcaatagttaatcattttattattttcaactttaaacatccaaaaaaaataaaataaattaaattaaaatcaaatagaaaatgcattattactataataatatctctatgtagacatatacatattatttcattgctttttgtaataaacgaggaaaatggtgggataaaaaaatgcattgttattccttcgaaaccagcagtaataagtcgtcctgagaacgatgtagatttagatctttacatgttggtactctaaatcacctccttccatcttaaagtcgtccttcttcttgctccaatcaaacttgcttttcttgctgctgggacaccaatttaaacttattaaccagatagtaaacaaaatcatgaaacaacagaaataacaccaaaaatgatcgtaaacgtgaccccttatgatatcacacactgaataatcatacacttcatcgtctataaccagtccataattgaaataaccgagtccgtatttcaatacaggtttatatccaccttcatcggtaaacgtacttggactcaaaactgtgcttagatcattagttccttggaatgcatgttctctcaataaggaagcatcaagtggagctgggatcatcctttgccaaagtacgttaagagcgctttcactgcctactgttgccccaaaaatttcttggccttatcttggcacaaatattcttttgcatttagttctatacatacagaaagagcgaaaaaaaagtgaaaaataaacagaatgtgataacggtaaaagaaaatcaaaaataaacaaaaaaaaatacatatataactattattcatgatagtaaacaggtgaattaagatatttagtacaattgtctattaccccaataggcataatcctcgaggaaaaagtcgtacaatacccacgagggccatattgtgcacagatgccatagcgcatgggcatcaatctgccattcgtaactaaaaaagtcaaacagttccaatgacatggccattgtggttacaatcacaagaagaattggaatgacacacagtttgaagatttgccgcttgaagctggagtacgcggttttcttgaattcgcccattagcttttgcttttgcagagcatggtagttttggcatgataacattatcaataaaatatactgtaaaacaccgaaaaaaatgttgaatctcatgttgtatgtgtacgaccagtcaacatagagtctcaagatgtgcagggcaaagattgccgcaactgacgcagtgaacgcttgtgctatcttggggtacaggaacatggaagtcattcttgcaaatattgcatgaaaccctgttaggacagttaaacctgcgaaaaagtaatctagcttctccgttatgatcaaatcacgacagtgaaagaccgagcttgctgtccaagccaacattcccgccacagtaacgtaaaggtagttccaaatcagtatacttctgctgttttttctcctcctatctccctcttcgcgtatgattctagaaaactttacaaatcccttataatgtggaataaagttacctatactgaatatcgtcgagaagaattcctgagtccccaatactctcaaaaatggccatttcccatggaattggtatatttcttcctcttcgtcaattctccagcgcgtaatgatgtgctgacattggtaatcacaatctgagatacaatcccagaacaataacttagagtacaaaggcggggtatcgaaaaactcaatatcatgaaacatgttggtttcagggtcaatgtagtttatttgggaattcggacatcttctgttatactcgcacgcatacgtacagtctataaactcatctaaattatctcctggagagcatgtcactaggaaacagtgaacaagtagggtcacaaccacagctaacctcatatttcttgccacacttctgtttcttttctcccgaagggtatggtttcacaccttaggttgctcttttattcgctttatgaaaaatgaaaaatgaaaagtacaagaatacgcaagagaagagcgaaaaaactaatgttgacatgacattatgcaataatttatttatgagagaaagagaaaaacactacaaatttttcataaaatcacgcctcttcaatcgaatctcaccaagaggtagtgtgacatcgttattccaaccccacagttttgaaccagattgaagattctcagacataggagtttgtaaagtggcattgtactcctccagttccttagcaattgcctctatgttcaatcgagggaacgtttcgtcgtcatatggatcgtccagtttatcgacgccgttgtaaagaatctggtttggcgtagaaggcttgaaaaacaacgttcttctatggaaaacattacgcgtggacaaatactcaatctcctgtgctatcatttcaggctcaattcccttcgagagtaggatcgctgcaactccggtgacaatgggcgtcgacatagatgtacctgacaaaattaaagtgtcgttgtagttcagatgagatagcgactcaatttccacgcctggggcaaagatgtttacacagggcccccaattgctgaacttggcaatcgtgtcaatgtggtcatcaaaggcccctacggtgataacgttttctgcagacgcaggtgaggcccagtaggcgtctaaattgaagttccccgccgcggcaacaaatacaataccttcttcaatggccccctccactgccatgttgattatggggctcctgaaactccctagacttagattggccacgcattttttaccctgtgggcgactgacctttgtgcaatgttccacgatgaactccagaccactaagaacgttactggcctcgccagacccgtctttgcccaagactttgacctccacaagattgaccctctttgccgctccatacgttttggaacctacgagtcccgccacgtgcgttccgtggccattctggtcgccaaacccttctttggtcaagtcaatcccctggatgactctgtcttcgaattccggatggtccgcgaagatacccgtatccatgatataggcgttgacgtcttgaccttgatagtcgtgttcatagtagtaattgaaccagcttttgtagcggtccttgtccccaacgtcgaatgggagttggtagtggcgggaaatccgggccaagtgacggggtgcgtctggttgatacgttatattttgctcttcctcgacgtcttcgtacgagtatttggcggtagcgttaaacgtataactcgactcggcgctatttacactgtcgccttcaaaagcttcgaacctgaagttgggcacaatatcagccaccagtgggcttttcttcagcttgttcactaagttcttggacaggttcatggtcacgccgcggaaggatccgatggagaatttcttctcaattttgttgtcgatgaactgtctccatgacctgttggaattcgaagtgaattgttggaatgctgtgggatttttgaacctcaccaaatactcctctgcgtatgcgaggttgaccagcaaagagatgagtatgcactgtggcttcatgaccagtgtttttttgctgtttttcttggcggatgttagaggatgtctagcacttgagtatacctctatatgctgtgtaaaatagaaaataaaaaagccaatgagaacaatattttgtgtcgttttttttattttcgcttcaattctctatacacgtacgtcatcactacgggaaaccaaaaaaaaaaaaaagaaaacagtacaaaaaggtttactttacccatagttagtatacgtagattttatacacgcactatttttcttatatacaggagatgggtggccacagaacccgcgcctagcctatttctttcttcttagacctgcctcgaggtcgccgacatccaaccttgtacctctgatgtagtagtgtttgtttctttgtctgctcgagacgtggggggttagcaagtcgattctctcgatcagcggcgaaaacaatggcactctaatctcgacggccgtcttggctatctggttccgcaacagcaacgaggcgtcttgcaccagttgtttgcggtctatggaaaggatgtagccaacaaaggtgtcgtacgagcacttggacgagtcgtacacaatccggaccacgtcgcctgccttcaagcggtccttgttctttttactgatgagcttcctcttaacggccccgggatccagagactctatttctgagagggccacctgcttcataatctgcgacgaagctatgcgctgcacaggtgggtacacggggatggtttttctcttggtggcggggaccatgtaggaccttgtccatgatccaagcaatctgacgttcctgctccacatcgctatggttctctctccctttcagcagctgctcagagggaagactcgattcttcttcttcttctttactgggagttccaaagcaccaaaattgaaaaccaagaaaaaaaggaaaatacatcactacataaaagtgcgcggagccattgaccactcacatacagatataagtgtatatatacaagtatacatatacaagtatacatgtagaaggagacagagacagagggaaatgtataagtgtgtatttttatagtatacaaaagaatatgcgtgtgaggatgtgtgtttcttctagaacctgtgtcttcttttcctcccggtgaacttggagtccttcgcaactttcctcccacgtcttttcatgagctccttctttcttagaatgaaactcttggcagactccttgtctttgcctcccttcaagcgctggcgcagttgtttcttcaagttgacgttctcctcgtccatggtcacaccgtccaaattcacctgctcctccccctgcggtggggccccactgctcaacacaaggtagtacttcttattctttttagactctgggtcgtccaccacaagcccgccactgaaccctgccaccttggcagactgcagtatgtcgtccacctggtcgtcgtttttcgggtagaactgggccacaaatttccctcccttcttcagtgcagcatacaatgtgttgaaaaacctcatcaaccgctgtttaggatcgttgtatgaagtgtccgcattgcacagccattggatcgcactgatactaatagccgcgtcaaacgagcccgcccggaacggtatcccggtgcccatatcctgcaacatcaagtcgccctccagctctctactaagaccggtcgcaagcatgctgggcgatatatccaaaccacaccacacatggtctccctcctgcgtcaaaatctccccagacagtccggacccgcacccgatatccagaatgaaactgcacggctgcagattcaaaagctccaacgccctcagcgtcatcttcgcctggatatgctgcactctggtcgaacccgtgtacttgtgtgcttcgctatcattatagaaaatctccggtggtgccaactcctcaggacgtgacattatttcttctctgatatatttcctgtgtttccgtaccgcacctttttagcactacttttttactatgctcttcttcttctgcttcttctgcttttttcctctttatcacactatgtatgtgctgctcatctcttctttttatcgataaaattgaaaaatgtgagatggtgtagagtgaaaaaaaaaaaaaaatctggcttggccatcaaatacccggccgtggttggactcgtttagcgaacaatagcacccagcagaccctggcaacatgcggatgatataagaaggacgagcgtggtggaggaaaggggcgccattggcacactcacgcaggtggttgttcagcacggcttgcagcaagagcgccaaaacagattgcaagaatgacggagactaaggatttgttgcaagacgaagagtttcttaagatccgcagactcaattccgcagaagccaacaaacggcattcggtcacgtacgataacgtgatcctgccacaggagtccatggaggtttcgccacggtcgtctaccacgtcgctggtggagccagtggagtcgactgaaggagtggagtcgactgaggcggaacgtgtggcagggaagcaggagcaggaggaggagtaccctgtggacgcccacatgcaaaagtacctttcacacctgaagagcaagtctcggtcgaggttccaccgaaaggatgctagcaagtatgtgtcgttttttggggacgtgagttttgatcctcgccccacgctcctggacagcgccatcaacgtgcccttccagacgactttcaaaggtccggtgctggagaaacagctcaaaaatttacagttgacaaagaccaagaccaaggccacggtgaagactacggtgaagactacggagaaaacggacaaggcagatgcccccccaggagaaaaactggagtcgaacttttcagggatctacgtgttcgcatggatgttcttgggctggatagccatcaggtgctgcacagattactatgcgtcgtacggcagtgcatggaataagctggaaatcgtgcagtacatgacaacggacttgttcacgatcgcaatgttggacttggcaatgttcctgtgcactttcttcgtggttttcgtgcactggctggtgaaaaagcggatcatcaactggaagtggactgggttcgttgcagtgagcatcttcgagttggctttcatccccgtgacgttccccatttacgtctactactttgatttcaactgggtcacgagaatcttcctgttcctgcactccgtggtgtttgttatgaagagccactcgtttgccttttacaacgggtatctttgggacataaagcaggaactcgagtactcttccaaacagttgcaaaaatacaaggaatctttgtccccagagacccgcgagattctgcaaaaaagttgcgacttttgccttttcgaattgaactaccagaccaaggataacgacttccccaacaacatcagttgcagcaatttcttcatgttctgtttgttccccgtcctcgtgtaccagatcaactacccaagaacgtcgcgcatcagatggaggtatgtgttggagaaggtgtgcgccatcattggcaccatcttcctcatgatggtcacggcacagttcttcatgcacccggtggccatgcgctgtatccagttccacaacacgcccaccttcggcggctggatccccgccacgcaagagtggttccacctgctcttcgacatgattccgggcttcactgttctgtacatgctcacgttttacatgatatgggacgctttattgaattgcgtggcggagttgaccaggtttgcggacagatatttctacggcgactggtggaattgcgtttcgtttgaagagtttagcagaatctggaacgtccccgttcacaaatttttactaagacacgtgtaccacagctccatgggcgcattgcatttgagcaagagccaagctacattatttacttttttcttgagtgccgtgttccacgaaatggccatgttcgccattttcagaagggttagaggatatctgttcatgttccaactgtcgcagtttgtgtggactgctttgagcaacaccaagtttctacgggcaagaccgcagttgtccaacgttgtcttttcgtttggtgtctgttcagggcccagtatcattatgacgttgtacctgaccttatgaactgccaccataccacgtgtgtccctcgcaagcccttgatagatatacaatagggaatgggcgtccgtccaccgtggtcaaagacaggggcaaagagctcctaggtctatatatatatctatatacatatttatatatattattagaactttacaatatagtatataccattcattgtttaagtttcgggtaatactttttttttccttgtcataaccccaaaaattttcgatgcctttgatataattgagaacaagaagagtttgcaggtgacaaaaatcgatgattataggtgttgtgacgacaaaatgaacgctaatatatgggtggctgcttcagatggtaatttggaccgagtggaacatatcctccgcgagagtaaaggcgccatgaccccgcaatccaaggacattaacggctacactccaatgcatgctgccgccgcatacggccacctggatttgctgaagaaaatgtgcaatgagtacaatggagacattaatgtgttggacaacgacggcgataccccgttgcaccatgtggaggatgtggccactgccaggttgatcgtggaagagctgggtggagacttcactatcaggaatgtggagggccaaacgccatacgactcgttcgtcgagaacggtgaagatggtgagctaatcgagtacatgaggattaagtccggcgtggccgatgttcacggagtggacggcgtgcagggtgagggtgtcatcgacagcaaattgctggaagagttcaaggacaacgtgagatacaccttggaaaatgaccctgaggaaggagccgatgaggccactctgcaacgcaggaggcagttggaacagatcattacgggagacaacgctgaggaggagttggaaaggtacatccgtgctatggtcagagagcagatgctgggccagggctccatggcgggttccggggacgaaccagattccaagagaagaaaataacgacccagcacaaaggctcttacagcttgctaaaagaaattgaacgcgacgctacatgaactacttctttctcttacatagtcttttcccttatgtatcttttctgtacattaatagacgttcttacaaggtaaaatttcaccgcgtttttaaatagaatgaaaaaaacgttgtagagtgaaagaaaagcaacaaatatacagttcacaaggcagcttcgtatagtaatacagcacgaaaaacagctcatagaaatggtaacacagaccaatccggtccctgttacatatccaacggatgcttatatccccacgtatctgcccgatgataaggtctccaatctggcagatttgaaaaaattgatagaaatggattccagactagatttgtatctgacaagaaggaggctggatacgtccatcaatttacctacaaacaccaagaccaaggaccatccccccaataaagagatgctgaggatttacgtctacaacactacggaaagcagccctcgcagcgattctggcaccccagcggactcaggcaagactacatggacactgagaatagaaggtaagcttctgcacgagtccgcaaacggaaagcacccatttagtgagtttttggaaggtgtcgcggtcgactttaaaagactgaaaccgctgggcatgggcaagaagaggaaacgcgattcgtcattgagccttcctttgaatctgcaacaacccgaatacaatgatcaagatagcaccatgggcgataacgacaacggcgaggatgaggacagtgcagaggcagaatccagggaggaaattgtagacgcactggaatggaactacgatgaaaacaacgttgtggagtttgatggtatcgacatcaagaggcaaggcaaggataatttgcgatgcagtataaccatccagttgaggggtgtcgacggtggaaaagtacagtactcgcccaacttagctaccttgataggtatgcaaacgggctccgttaatgacgcggtttattcgatctacaagtacattttgatcaacaatctgtttgttacggaacaaacagaggctcaagatggttccaacgatgccgaagacagcagtaacgagaataacaataaaaacggtgctggtgacgatgatggcgtcgagggaagtactccaaaggataagcccgaattgggtgaagtgaagctagattcactcttacaaaaggtattggatacaaacgccgcgcacctccccttgatgaatgttgtgcaaaccgtgaacaaactggtatcacccctaccgcccatcatcctagattatacaattgatctttccaaagataccacctatggtgctaccaccttggatgtagatgtgtcgcacattctccaccagcctcaaccccagccaaatttacaaaaagaggaagaaacagatgctgaagacacagcaaaactacgtgaaatcacaaagcttgccttgcagttgaactctagtgctcaaaaataccagtttttccacgaactgtctttgcatccaagagaaacgctgactcactacttatggtcttccaagcaaaacgagcttgtgctgcagggcgaccaatacttcaatgaagatgctgcaagaacgagtgacatatacagtaacaacaacaatgacaggtcactaatgggcaatatctcactactgtactcccaaggaagactataacatcactgtatgatctcattctttctgcaattattgcacgcctcctcgtgagtagtgaccgtgcgaacaaaagagtcattacaacgaggaaatagaagaaaatgaaaaattttcgacaaaatgtatagtcatttctatcaataacgtatacacgtttttttaatactatctatattgtgtatcttatatttttccatttggtagtatagcagcaaatatttgttcttagacggccaccatccctcacaccaatgcctaacgcttcccaagtttacagatctaccagatccagctctccaaagacaatctcttttgaagaggctatcattcaaggtctggccactgacggtggtcttttcattccaccaactattccacaagtggaccaagccactcttttcaatgattggtcaaagctctccttccaagacttagcctttgctatcatgagactatacattgcccaagaagagattccagatgctgatctaaaggacttgatcaagagatcttattctactttccgttctgatgaagtcacccccttggtgcaaaacgtcactggtgacaaggagaatttgcacattttagaattattccacggtcctacctacgctttcaaagacgttgctttacaatttgtcggtaatctttttgaatacttcttacaaagaaccaacgccaatttacctgaaggcgagaaaaagcaaatcactgtggtcggtgctacttccggtgacactggttctgcagccatctacggtttaagaggcaaaaaggacgtttccgttttcatcttatatccaaccggtagaatttccccaattcaagaagaacaaatgaccaccgttccagatgaaaacgtccagactttgtctgttaccggtactttcgacaactgtcaagatatcgtcaaagctattttcggtgacaaagaattcaactctaaacacaacgtcggtgctgttaactccatcaactgggcaagaatcttggcccaaatgacctattacttttattcattcttccaagccaccaacggtaaggactccaagaaggtcaagttcgttgtgccaagtgggaacttcggtgatatattggccggttattttgccaagaaaatgggtttgcctattgaaaaactggccatcgctaccaatgaaaacgacattttggacagatttttgaaatctggtctatacgaaagatcagacaaggttgctgctactttatccccagcaatggatatcttaatctcttctaactttgaaagactactatggtacctagctcgtgaatacctagctaatggtgatgatttgaaagccggtgaaatcgtcaacaattggttccaggaattgaagaccaacggtaagttccaagttgacaaatccatcattgaaggcgcatcaaaggactttacatcagaaagagtttccaatgaagaaacatctgaaacaatcaagaagatctacgaatcatctgtaaatccaaaacattacatcttagatcctcacacagctgtcggtgtttgcgccacagaaagattgattgcaaaagataatgacaagtccatccaatacatttctctatctaccgctcacccagctaaatttgccgatgctgtaaacaatgcattgtctggattttccaattattcatttgaaaaggatgttttgcctgaggaattgaagaaactatccacattaaagaagaaattaaaattcatcgaaagagctgacgttgaattggtcaaaaacgctattgaagaagaacttgctaaaatgaaattataagatcttcctttttaatgaatatattttatcttatataacatatagaattctataattaatagagagtatgaagtacgattatccttaatgttaatcaaagtgaatcatgattgcgagagtaaggaaccataaaattaatcttcatctatgctaataatctcagaattctcgttcccagggtcttcttctttagatactaatctaactttcccgcccttttcaactgatatttcaaacccagctttgctcaatgcatcgtcttgaacaacgtcttgagcttccatttttttgacatattcctgattcttggcattattctttaacaaaaacttcaagcaaacaatagatctttccttgataaacggatcattatcatcgatgacacaattggaaagaattaatgcaagaccacctaattctcttatttgatcttggatttcaggatgtgcatacactaacgatgccaatatttcgattattactaatttacaatggggaaaattatcagccctaataaaggattcgttggtattaacacggttgaaaattaataaccggtcctcgattttgttaccttcatgatctgtgattttaatttcattcaccgtatcaccgtttcctttcaaaaaattaatcctcaacaaattcttttggaaagtatccaagagagataccaatattttcacagagtcatacgaaattaagaattttctaacatgattgaatttgcacaagtcagaaattatgtccaggcaagaaagtaaagtggagtgtaattggatggcaactgaaggagcataatcgttacaacttttattgaaaaaggcaggaatatccttgcatgcaagacgttgcagaatggggtagcaccatgacataattgcagtcaactcataggtattccaatcttctttactcgttacaaccaattgcaatatctgcaacaaagtggtgaattttcctggctgtctttcttctaacccattgaggtatttaccaaaagaagcagttgtaagacttttgctaatacattctaagacagataggtcaatagaagttatttccaattttgaatcatccagatagtttctgcccttctcaattaaaaaggaattctcttgatcctggatgaatttggctgtcactatatcgaaaaatattctatccctaacacaataatagtctttctggggtgtatcattatccctgaaaaattcgttggaaaattcatcattgttgagatacgtcttgaaaagaaataaatatggtagccagaaatgctcttcttcttcaccgtcttccaatttgatcccataagggtattgaagaaattgtaaaagagctggaaaagtagtcatatccactgtagagtagttctgctgtatattgaaaaggcacgttaaacatgcgatgtatagatgtttgattagcggagtgtcaacgacatactcactagttgcatgcagaaaaccacgaattacgaggttttgtagtaaaagcttttggggtatttcctggttttcagcggcaaggtttctcatcattaagataaggcccctcactgttcttgtatacggtattgagctattctcatttaacgacgctggcaacagcattgcttccaaggtgtctcttaatcgttcccaaaaaagctgggagttagccattgatttcctatgttcttcatcattaaacgtcctttgaaatatacggttcaggttttcgacgattggctcataatcctcgacgcaacatgggtcgttcttcatcatggtaatgattgaatcaaataaattgaattcatctagaaaattgttcataggcattgttatttagttatcttcttttttgatgaatcaataattttataaggcttagtgtaattgttctcccgatgatagtatgaaacggtagtcgataaatttgtgtcaaattttttcctcatcccatcaattcttcattttttcccttcctatttttttttttactgaagcgatgatgccttatatataaggaaaatagcctcgtcagtcaaaggacgactcccgtaatggtagcctcagtttatattaggcgctctcatcatgatgtatatcgatattggcgatgatatttttttttgttgatattaaatacaaatgtaatgctttatatagttctatacttggggaatacatgatgtgaatgtgcataaatagaggacagtgaatatttttcaaggaagctctttctcattttcttcttcatcactggaatcattttcattagacaagggtaatttgttatccttcccattgaaaccaatccatccttcctcgtcgtcagattccatgactacatcgttctcttcgttctcttcgttatcttcatctgcgtcatcttttaatagaacctcgtcatcatcagccgcgccatcttccatggacccatcagttgataccaaaaatctataggtgtatttgttatcagtagtggtattgactacttccttagccactctaacaataaatctttgtatcgacctcatagccgtcgagaagagatatttgtgttcatttatgtaaccaccgctcgcagataatagagctttgatccaaattaggttaaactcaatgtgttgggattcaatggcaaaatcaccgatgaacttcagaatcctcggtaaatatattgcaggaatattacttgcaaccaaggggatttccttaataggtatggcttcatagactttattgatcaaatattcttcatttaacctgaacgccattactaatgcatttaaaaactgcttttctcgtagcgcctctacagtagaatggggggtgacgtccacatccagatcaaagggatcaaataatatcgtgtcattggtggaatatatcaataaaccttccgttgaagcagcggcaaatgcattcgccgttggggagaattgcaccgaagtaactctaacctctggtctcatttttcttgtggacaggtcgccacctctttgagaccctggtaaagaattatcaatacgatcctccaaatctgaattttcgcctgcatcgtcaatcaaatctaatgaacctgcttcagtcattttcttactgtttaaaaattcgagagtaccattcaaagccatgtttctggacacaatgaatctttttaacaagacttcatttggaacatcatatagacaaatggagttattattaccaccagccacaatagccataccatcaaaactgtaatgtattgtagtaaaaaatttggatcgttcagaattttggcagtgaacctatcttgattaaacctaccagatattatatcctttctacagtcaatgttgcccacctgcttggcatcttctatgttgaaaatggatatttgaccctttaaggtagatactgcaacttctttaccatctggtctcattgataaggctaaaacatcggaataaacttctataggttctacttgttggcttctaccaaatatggaccagattctaattgttttatcccatgatgcagaagctaagacactgttctcttgactaaatgaaagacacgaaacagggccttcatgtccggacaaagcatctaataattgaccagtttgcacggaccaaacatgaatgtcaaaattgtccagggacccggcacaaaccacttcacctgatggatccaccgctaaacaattgaattggattctttcagtaccagtgaatgttctaaaattacgatacctgattaagtcccacgctctcaccgtaccatctaacgatgatgagaacatgacctgaccccttttcgcaaactgtacagcagtaactgaagaggtgtgttcttcaaaagtggccaaacaaaaccctgatgtaatgtcccaaactttgattttcccatcttcggatgctgtcactacacgtgaaccatccggagagtatgcaagactatttgtggaatcgaaatggccctgctgcttcaagatatacgattccgattgccattcgtaaactagtaattggcccagtttgctggaaccaaacgccagccattcgccggtttggttgacgctaacggtgttgactgggttttgccccatagaaagctgttgaatcaaagtgaaatcaggcaaatcgtaaagacggaattccccactagtaaatccgacagctaaaagccttgttgctggatggaaggtgacacactttactttggcttggtttgcgtaaaaaaaatgtttctttgtgattctccagctgtatttcgaaatatctacttcttcttgcttgtcgtcgtcttcactttcattgtcgtcgtcatcggatggcctcttggtaaattcccagacaaagacagcaccgtctttgcttacagtgtagattttttcctgatcatgactgaagaacgcacccataacgtagtctctgtgcccattaaatgttgtcgccgcaagttcttttcctctgaatctacggaccatatttttgcgcttaagtctttggaagtcgtaaggataaatctggaatcttgtgaccacgtcaaagacgttatgtcttgaaagtgtcccgcatgcaccctatggcggacgaagggagcaaactgtctgtctttattaacatctggagtcttccaaatctgtaaaaacctgcctgaggctaatgcaaagagtctcccatcagggctgaacttcacagcggagatttttctttgaagttgaaatggtgaagcacgttacgggctttgaaattgacaaggatggcgcgaccgtcctcgtcaatagaaatcagcaatgtgccttgtttgttcagatcaatggcagcaatatttttgcgatgctcgtattcaaacgtgaacgatttgttgttgattaagtcaaacacgctgaccctattccccaccggtgagagtagttgcttgccatcatcggaaaaggtgatgttaccttgcctgtagaccgtacctaaaaggttagagaacttgaaatcggatttcattgggatgcggttcaatctgcggtctgctctcctgtctacctgttgaaaacgatactattattactattattgatattatactagttattgtacatacctagaactatactcgaaactttttttttttcatctttcagctcatcgcaaaatttttccaaaaaatttcaaaaagaactcccgtcgcatgtgatcaaggttacaggtgcttgacataatcataatgattacgagtcgaagccggccctgacaacagcttctcttgccgtagaattgatgtgtttaaaccggtcgggacctatgtgggcaccgccgaaccaacgggccaccacaacgatgacgttccacacatccatgatggtgatgaggtgcagcattctggagccggcggccgtttcaccgtcatcatcggaatcttgatatgttgccgcagagccatcctgcttgattcgccatgcactcatgacatggtttgccttacgcatcttggagtcggtcttcagtaggtctagcatggcaaacgcttgttcctcggaggtaacatgtgctgcaaaggccatgaaagtcgagcctctatcagtaatggggtccgacgcggtccagccctcgaaggggtctgtgggaatgtcactctgctggaccggttctgtctcctcctctggttcaacgtacaagacaccgtcgagttctgtgaggaagtcaaatagacagacagatccgcggtggaaaacagagtccatcacttcctggaacaaatgctgaaggtacttggtatcgtagagatcgcgcttagccaaagaagtgcagacaccaacttcgatgacattaggagcctcctcggaggggtagtgtgtcgggaaggagatctgcagtgtcatgtattcatgctgcggcactttcacaacgatgatgcttccgtcttcctgcttcttggagagaagatccggatagatggcctcgacggcctccagttcttcgaccaactgttcgtgatcgtcatccattgagcttttctttcctctctcttttttttttcttgttacatattcctatatatatgtatatatatctatatatatatatatcccagcgtatatgactgcacaagacgcaattttcttgaacggttttttcttttcagcactgcgaaagagagagcaacggtaaagagcatgagccaatttgaaaagcagaaggaacagggcaattctttgttcaaacagggcctgtatcgcgaggctgtgcactgttatgaccaactaattactgctcaaccgcagaacccggtcgggtacagcaacaaagccatggcgctgatcaaactgggtgaatatacacaggctattcaaatgtgccagcaaggactgcggtacacctcaacggcagagcatgtagctatcagatccaaattgcaatatcgtctagagctggcacagggagcggtaggttcagtacagatccctgttgtagaggttgatgaactaccggagggatacgaccggtcctgagaaaagagaaagggaacacttctaatttatctttaaaattatatatatatatatatatatatgtgtgtttgtatactctgtgggtatttccgtgtatatggttaataatagtagtatcttgtcagttttttttatgtttttcttcgcgcgtcaactttctaccaagagaaaaacaatataaggtctccttactctataggagaataaaacaaacaaaaataaaaagcacatcgtagcgccaagaaaatactgcaaataccaaataccacaataatactacaattatctatacacaagtgttttgccgcttaaaacttcgattttcatagtacgaaactatacacccttggtttttctcttttctaaatacatatctaccttgtaaagaatttcccgcacatctttgcgggcatacagttcatgtattggcaactaacggaactaaggcaacatatcttgcatattgcaatgttcactacatagatgaaaacttatatctaggtttcacgacacgagaataactaagaagcacgatccatgatatagaaaaatcagttacgacgaagcacggcaaattagccgccgaagaccgatatttttgccaccggtcacagttttcttttccacggagctcttcgcggtttttttgttccggattttttttaccggctcttagcggaccgttttggttataaggggagtggcagcggcggtagacactgcgctctataagaatacttgcaagggtcttgtctattgtataattcgctagtatttgttttgcattgtactcttaataccccaaccaaaaacaaaatagtgagagtaatggtgcgttttgtttcaattttaagtttattcggctgcgcggcgacgcttgtcacggcccatgatgacatggacatggacatggatatggacatggatatggacatgaatatcgatacgacaacgtctcaatccatagatgtctcatccacggcttcaatcgtccccgtgccacatgaaccaaaacatttgcatggccttcctatactgcaatcgccctcgcttacccctgcggagagattgtactgggaaaactacaacaccacaacctactttactacacaggctgggaataggtctgcccttcgctaccacattattacgctgctcttggttgcatttgtgctctaccctgtgtccctggcgctaagcgccgcccgttctaggtggtacttacccctgctgtttgttaatctatgcatttgtatttcgtccgtaatggcattgtccgtgttcaaaaatactttcccggaagaagactggtatgcgcataatatctatggcaccacttctgtgctacttctcgtttttatgcttgttcacttcttcgctgcggtgctttctgtccccgtctcattagcatcgaaaaaggagtaccgtccggttgacaccatccctctgaatgatcttgaatctacgcccgtcatggtgaatagtgcacgtggctctccaagtccttcttccaacagagacacgttgttctcgctctcttcagacaccacgaccgccacggccaccaataataataaacggagacgcgctgaaggcgaagacgagggtgataacacctccaaccacgacactttgcgcgacgaagactacgataatgatgacgacgaaattgcttccattgaagcgccacctctgcttcctcaagacatacccgttttccgaatcttgtttaccaacacgaagtaccagatgcttgccgcgcacctctcgtgcgtcgccaacgtggtctttcacatgcttacctacccgctattcatgtacatctttgtagacctaatcatcggcttcgctgtaggtaacttgctcggcaagggcatccgcatctttaatctcttggcccactggattaagggcggcgtattttttactctgggcgttgtctctttagcaagatactgcggtttcgcagctaagtacggctgggcatggaacaacatcagcttcacctctcaactcacacaaacgcgttcctccaatcttcttttccggtttgctcctgcggggactttcaccatggaattcgttgaatccttcctcattttcttttacgggtccaccaacatcttcttggagcacctggcaggaaacggcggcgcatggactgccaaggatttacagcatgtgtcgataaattctcaccggccccaaggtgtgtgggctactcacggagtacaagctcaaccattggcgattcgagcatgcccgcaaacggccacagaccgatgtagttgctgccacaccggggtactctccaaacccgttccccgctttcaccatattttggactgggattctgatgtcccagcacgcacagtcctcgcaattttctactaccattcacacgcaatggggatacttgttgtcctatgggtccttcttccgtctgctaacatttttgattctgtttttggtgcccaacaccaacagtgccgcatccaagcctttcacggagttgatcacctcgttctgtctcctctgtggtggtctggtatttatggagtccacggatcagtccattgaagccatggaatatagggggtttacccccatgttcactttcaacctcagtgttggattcgtttctttgttgatggcttgggaaatgattttatttatttggaaagactggctcatcaaaaccaggaaaaccagtctttaaccgccataatggcttttcttttttcttttttttttcacccccccctcatctttgagtgagaagcttatatgctttacttttcctcacctactttttaattcttaattattagtttatccagcattcagtcaattctgaatgcgttatcgcttcctcaaaatttataaaaatgaataagcaagatctcattggaattgagttcaatgacgattattgagggcccatacctgataaaagtgaatatattatgtataatgactctactggaggttctctctgagaatgtaaaataatccacaaaagacatgaaaattagttactctacataatgtataataagttcttccttccttttttctttttttagtttttctactcaccatcctacctacgccaagctgctctactgtcttggatctgtgaaaaaacgcctagaaacatgtataaaacctaccgctttaaaccataatttcaaatcgaaatggcactatggccgagtggttaaggcgagagactcgaatggaataaaaagttcggctatctcttgggctctgcccgcgctggttcaaatcctgctggtgtcgtttaattttttttaaataacatcgttgattaaaacaatcctattcactgcagtcacagacttagcacatttacaaccagtacaagatcaatcacacgcgttgtggtaggaactttgacgatgatactgcgttggctcttgaacgcatagtacatttgtcgttcacaacggaaagtgaaatactgaaaaaaaaagaaaaattttcttagggactcatcatcaatgtaaacacctctacagccgtcaagactagcaaagctcacctcacaaaacgacatgccgcgcataaagaccagaagatccaagcctgcacctgacgggttcgaaaaaatcaagccaaccctcacagatttcgaaatccaactcagagatgcccaaaaggacaagtcgtctaagctcgcagcaaagtccaatgagcagctctgggagataatgcaactccaccaccagcgctctagatacatatatactctgtactacaagagaaaggccatctccaaagacctttacgattggttgataaaggaaaagtatgctgataaattgctaattgccaaatggcgcaaaaccgggtatgaaaaactgtgctgtctgcgctgcattcaaaagaacgaaactaacaacggtagcacttgcatctgcagggtgcctcgtgcacagttagaggaagaagcacgcaaaaagggcacacaggtgtccttccatcagtgcgtccactgcggctgccgtggatgtgcaagcacagactaacgactatatgcacgttgcagtattgttctggccatgtaattatctctctcccaacgttttagaagaggttttcgtctccttcgtcaaagacgaccactttcccattttggtcattggaacgcgaaaaaacaaaacagacgcgagaacgcgacgcgaaaaaatatatttttccgttttttttttttttcggaacaaagataacgcgttaaaacctgtggatgtaataaggatctgaaacactgactaaaacgcgtcctcatttaaaatcaaaaaattacttcttctcctccttacggtgccctttgatccttctcaaactttaaatatatgttgcatgattaattgaaaatcatatagagtatatcttaacagaggttccaacgctttaaatcgtattctattcttttccccccttttattatagttacatctactatttgagcttcttttattgaccgaaactacctcttatttcgaagcaaaaaaaaaaaaaatcaacaaaaattccaacttttcaatgatgaatgaagacatatccatcattgatggccataatagttttttaacggaaaaaagcaccgtgctattaacccaagccaagagaacactagaagacgaaaaggaaatgattactcccccgagctcaactgtgagaaaaacaatgaaggaagtaaataagaggccgtcgcatcccctctcaccggatcactcgtccccaattgctccatctaaggccaagcgccaaagatcggacacatgcgctcggtccaatggtaacctaaccttggaagaaattcttcaatctttggaaagaagaagaataaatggtgaactcgccaagaaacctccatattcgtatgcaactttgatttgcttggccattttgcaatctcaggagggaaagctaacgctatcccagatatatcattggatccacgttcacttcccttattacaagcagaaagatgctagttggcaaaattcaataagacataacttgtctttaaatgatgcgttcatcaagactgaaaagtcctgcgatggtaagggtcatttctgggaggtcagaccgggtgccgaaacaaaatttttcaaaggtgaaaatcgtggttatgaatttgtaaaggactccttacaagacattgggaagtattttgaaatagattctacacttgatgaattagaacaagttgagagtggagaaggcaatgatgatcttcctgacgaggaagaaagagaggaagcagggaaattcccttccattgaaattcaattgaactcctcccctatactgagagtttcccagttacatcacataccgcaattgaaaacagacaacagtgtactgaaccctcacgaaaacctagaatcgatgcggaacatgatagaaaacgatgtcaacaatatagattccttggaacctccttatgtcatgaagaaatatcatacttctttaggcttaccgtcgctggtgaatgccaaagatcatttccaggcgggtgtgaaaaacaataatatcacccaggcaaatagatttaatacactccctataactagcgcaaagtctcctcagaatttcagaaaatatttcacctcattcaattcaaattttgaagatttatctccacttcgaagtaatgtaggggctggttctctactcgacccacttccgtattccccattgaagctgtacgatcagaaaaatcttgcgctcatgtcgaaaccacaatctcagcaatcatattccaattctcaacttccacctccaccttcctctcatggttcggacttacttaaaacacccaagatgaggcattccgatggcttagagaaaaccccatcgcggttgataagcacacctaaggacggtaactcgattttgaggaaatggcagactccttcacacctttttgaagatttgtactgttctccgctatttagagctatagagactccaatcaggtatatcacgacgccggggggcaactttggaaacccaaatttcaccaagaaagtcctctgcacccgatgtcctcacaagcgcaacgaattccaaatttgcttcaagcgggctgtttggcgtggatgtttattctgtttggaagcgcgcaactgaaaagatttctgatggtaacaatactacggatagcaatcaaaaacatcatccttatcataatcacccttccaacgatagcggtaatgaaaagaattgacttttttttttttttttttttcattttcttttcctcaccgaaaactaattattcttaatctgatggattcatcgcaaacggttggatgagtcctaaactgggctggagttatcatatcacatagcattttctttttaatcttattgtattgtcgggtcaactaacttcttttcccgctcttctatggtataatcaattgcagaagaggcaggaaaaaattgtaatcataacaaaaatgatacaaattttttttctaagttttatattttacatatctttattttttgatccttacggatttttaatacagtatttagctgaagtttccattcacttcacttacctttttgatctcttttatttttacttgccccgttgccttgcatttttcaatagaaagtgaaaaactaagtaccacttgagcaatgccacattagaagaaaaaccatccgcaagtgagcatcacagctactaagaaaaggccatttttactactcatggaccaccaaataaccactgcaagcgacttcacgactacttcaataccgagcctgtaccaattggatacacttttgagatgtcacatttgtaaagattttctaaaagtccccgtcttaacaccttgtggccatacattttgttccctttgtattagaacacatttgaataaccaaccaaattgtcctctctgccttttcgagttcagagagtccttgctgagaagtgagttcctggtcagtgaaataattcaaagttatacatccctacgatcttccttactagatgcactaaggataccgaagcctacccctgtccctgagaatgaggaagtaccaggtcctgaaaattcttcatggatagaactcatatcagagtctgaaagtgacagtgtaaatgccgctgatgatgacttgcaaattgttgcaacaagtgaaagaaaacttgccaaaagatccatgactgatatattaccactgagttccaaaccatccaaaaggaattttgcaatgttcagaagtgaacgtatcaagaaaaaatcaaagccaaatgaacaaatggcccagtgccccatatgtcaacaattttatcctcttaaagcccttgaaaaaacacatttggatgaatgcctaactttacaatcactaggcaaaaaaccaaaaatttctaccactttccctacagagtcaaatccacataacaaaagttcatccagattcaaggtacgaactccagaagtcgacaaaagctcatgtggtgagacctcacatgtggataagtatttaaactcaatgatgagtgcagaacaccaaagattgccgaagatcaattttacgtctatgactcaatcccaaataaaacaaaaactgtcatcgttgggactgtcaactaatggtactaggcaaaacatgattaaaagatacaatcactacgaaatgctttggaattctaatttttgtgattctctagaacctgttgatgaagctgaactaaaaagacagttgttaagctgggatgtttcacacaataaaaccccccaaaatagtagcaacaagggtggaatttctaaattaatgataatgaagagtaatgggaaatcttcttcatataggaaattacttgaaaatttcaaaaacgataaatttaataggaaaggatggatggttatgtttcggaaggattttgctaggcttatcagggaagcaaaaatgaaaataaaaacaggttcatcggacagttcaggttcagtgggacattctaatgatggagatggtgttgaaaaagttcaaagtgaccagggaaccgaggatcagcaaatggagaaggatcaggacactgttatcaacgaagatagagttgctggtgaaagaaatttgcctaacgaagattcaactgatgctgacttatcaagagaattaatggacttgaatgaatatagtaaagacccacccggtaacaattaaggtgtgtatatgtaatcaggcctgtttgttagcttgtgcacatttgttaattaataatttatttaaaaatgggcaaaatataaatgcataaaagatgacatagagatatgtgcacaaagctatgtaatcatatttaacattaatatatattatttcgttattcacaattcgtcatgaaggccagcgtagtttacggttcctgctactgcattatcatcgttgacaatgtttgtattcgaattattattcaaaggtgctgcaattgtttgcggaggggccactggattaggcaaagaagtgatctccacgttaagtgctgaaataacttcactagatagagagacgtcttcggtaacatctaccgtaccagatgcctgcatttccgtcgtaagcattcgggaaacaggagtatttacattttcgctgattttgtggcgtaccccaaacgcttcagatgaatcttttgatgactgtacttctatcattatttctttctgtacaaatcctgatgcatcaattgaactagcagatattttgtgagggctacttacaaaagatggtgctgttgtggttacacctggcatcggctgagctactgtgcttgacgcgctctccacggataaagttcccttgcctatatcagacagagcgccaattgaagcaccactactactaaagatcatagatgccatagaagtcccttcaatatttgtggattctgatagggaagattgaccaacactcgtcttaggtgattgtacagcatcagtgaaaacactagtgggttccgaactgtcagccaaaacactagtgggttccgaattgtcagccaaaacactagtgggttccaaattgtcagccaacacactggtgtattccgaattatcaatcaaggcactggagcgttctgaatcctcggtagagaaagcaattactctcgaagtcttcgtttctgtttttgagaatgagctagttgccgtctccacaatagctgatgaaacaggttcagagatggaatgaaatttagaaaaagtggaatctgagattgaagggattgattcagaagcaagaacagaagaagttacagtcgatacttctattgactggaagccagaggttatagatgaatcagaaaatgtactcggatgcgaggaaatagagtcctgggatgctgatgttgacaaaatttcttcatttgggatcaaattagacgcaactgagtcaaattcggatgctatagaaatagaatgcgtaggtgtttcaaccatacgctctaattctgatgctatgggatcaatttcggagacgggcgaagaaaccatagtgtctgtgggcgtcaacaacattgaagaagatgttgtaacatactgctcggcttctgcattggaatctgatgcaggtatattcctatactcaatttttgtaatgacttcagtgattatttttgtcttataaatctctctcgtggatgccggttttgagttgtctagaaaagatgtgttggctgcatcattggtggggtttgtttgtgtggtggtaaccgcagtcgcggtacttgtggataatgctgtagtagggctagttgttaacgatgaggaaagagataatgaagatgaagatgaagacggcatgtgtgatagcgaaggtgattcagtacttaagagttttgaaacgctttctctatctgttgttatttcgctttctgattgttctactattaacgaggacaatttctcctccaagtcaggagtcggctcaggatattctgtgatagaatttgaagatgaggataacaaatctatcgactctgaattcagtggaagcgatggtttttcgacaatattcggttctgtaggagaggctagcggcttcgtaatttcagaggtaggtgaagacacaattggttcattagtgacactctcttcatagaaagaagaagaagaagaagaagaagaagaagaagctgatgttgggatatctgcagaagtgaattgtgaatcagctgatgacgatatccaaacaaatttttgctcatcttctgtggtggttctcatagtgctagtgtcaaatgaggaaaattcagtctctatatcgctagcaacatctgtagcgctgatgatatctgcactttcagtaatgcctctgtaatcgtcattaatagtgaaataagaagaagatccttggtctatggtagtgttttccttgaatttcgacttatatatatcatgagcatgtttgtaaataaagccgtgcacattatgtttgtagcctagttgaatagcgccagccaaaaccactaacaaaacaaaattcaagaaaaatttccaaatatttcgtaaaattgatgacgatgtaccggaaagcttcagaacgttgatcgtgttccccatagaagtgcttgccaaatatctagaatctggagaaaaagtaacttttgttatagtagattcatgtactcttggaaccaactgaacaagctttagcttttcaacgctgacgatggcaaccaagttatcgttagatgataatgcaacgaacttcttatttggggagacatccatcgatgttattccattcaaatcgaacatgaaggatgctgtttttaaaattttaacacctttggaactcacacctagttttaacaaggaaactccatcagagttcgataatgatgctgccactaatagcgtattgtcattgagaaacctgatattagaaagaacaagatttttatcaaaatccgttttccttgctacaaaatttccgtccctaacagacgctacttccaaagaattagaagtgatatatgacaaaagaataccgttaggggcgaagtgcaaatcattaacttccctacccgtttcaatttcgtaattttccgtcaaattacgcgggtcaatgattcttatcacagtgggcacttcagaggacgcaattgcagctactgtggccctttgattaatgtaaacaaacttagtgaaaacggatgggtctgtagttctgttgaaatcaatactggccacgaattttagatgttcttgttcaaacacaaacttcctcaagtggtggttaacgttctccatggaggaatcattaaacagttcattgcaaccaactagaatcaggttattattacaatccaatgaagtgggcgcatcgtcaatcgaatctaatgtgatctcacgaaaccttctaatgtgtttctttttctggaagttcacctttaaagctgtaattttgtttggaaacgaggaattgaactggcctccaccaccagccaccagtagagtgccttcatttataaatttagcaccatatatcggatatccgacgtcatagtttgcagagttgccactcattattatgctagtttttctaagtttaaaaggagagaaaaaaaaggaagagaggacgtatcgtagggaattgtgatgcttgttgacaaacagcctccgtcgatcgaagcagctataagcgtaggttacttgaagcgttcacagttctcatttacactgtacaattctcgagatataaatgaaaattactacaaccaagaaaaaaggacaggagggctaaaaggataataaaatagggcagttacaaatgtggtcaaaaatactagggctcaaaattgctaagtaagggcttgacagatgtaacataatacgaaataaactggatatcgtttaataattatcaaggtgatttaaatcgtaaatacataggctgggcatatacactaacatgtgtcgtgaccaatgtgcagcagatagacttgctcattaaatatattccaggtaggattctctaagggttttttttttttctctatagctgtcacttttttttttttctcttatcaatcacagatataataagcataacatcggaaagaaaataatgatagggcaaaagggaaagcatttccagttgaatacagtatctctactatattgttgttcgctgaagacagccgtttccggaaaaaagtgattgtgtgatcgcagttacccgcacctttgttcaacagtacataataagaatctgtagatatagatgaactttctctattacataagactagcctaaaagccttgtttctatcatttaaaggcttttgagacactcaaatcagtgtcaaccttttggataagtcaaagaaagtacgccgctgctcagaaaattgttatcgtgattgagaactgatctaggcattacaattaaaggaaacaagggaaatattctattgaatgttgcataaaagcccttcaagaaagagatttgcttctcctttgcatctaggatgcattctaacgcttacagtgctctgccttattgcttactactttgctttaccggattatttatcggtagggaagagctcatccaggggtgccatggatcaaaaatctgatggaacctttagacttaagtctatctacaggcatggcgtcggagcaaaccatcggctacaccagaggctggaggtcactccagaagttatttctgccgctggaatgctgtatcaagaaaccacaactcaaggacaggatttcgaagaccaagaacccctatggactactaatgccgaatatgccaccactaacccattcgattttgagtttgagctacgaaggatgccgctattgatgaagcggatgaaggaaagagatcctgaattcatagagtcgtacatttacggagaaacatacatgacggaggaggaagaacacgccatgtggatagatgatgacattgtggcacccaatatcacagatagaggtacagtagtgtcgttagcattaatgtcgtctaatgcttacgtgagaataccgcaaacgggagactggcgtaacgtcacggagccgtggaatgaaacagagccggaagattttggttgggatggtgatggtatacgtggtcacgtcttttacaatgaagtggagaatatcgtggtactctcgataaagggaaccagcgctcagggtttgccagggtctggcgaagatgagacaactggaaacgacaagatcaacgataatttgttattttcgtgttgttgtgcaagagtgagctacctgtggactaccgtgtgcgattgctatgtgaagtcgtatatatgcgatgagtcttgcctggaaaaggaactgagacgtaaggatagattttactctgcagtcgttgacatatacaaaggcgtcctcaaagaatacccgatgcggccatatgggtcacaggccactcactgggaggcgcattggccagtttactgggccgcacttttggattgcctgcggtcgcattcgagtcccctggagagctactaccttcaaaaagacttcacttaccattcccaccgggacttccctcatacatggagggtatctggcacttcggtcacaacgcagacccaatcttcatgggtacatgcaacggagctagttcaagttgctcactggtgggctacgctatggaaaccgcgtgccacactggtagagtctgtgtctacgatgtggtcaacgacaagggctggagtgtaaacatgttcaaccacagaatccacaaagtcattgacgaagttctccttggataccgagcaggctgccaagtgcgttgaaccagagccctgcgtagattgctacaactggaagtttattccaagcagagactgggaatcctcatcgaggctcattaccaagactaaaagccacgctgcaccaaccacgacgactcgcaccactgctactactacctcttcatctacctgtgtaggccgcaattggcttggcttctgcaccaaatacgagttgtaagacccatacatctattatgaccctagtgttgttttagggcctatgcgccctttttttcttccattgtctgataaataatgtatcattttgacaacttaaaggttcagctaaacgacacgagaagatatattaatactgctttaaagtgaaaggcgtcagtcaggtgcaattaataggtcacatattctttgcttcaattgctctctagcaaactcacacactcgtagattggaagaccgaagaaaatagatagactttcgaataagttcagcaacaacatgtggttgaaatccttgctgctctgcctgtactccttagtactctgccaagtccacgctgcaccttcatcagggaagcagattacctccaaggatgttgatcttcagaaaaaatatgagcccagtccccccgccacacatcgtggaataatcactatcgaatactttgatcccgtttcgaagtcgatgaaagaggcggatctgacttttgagttgtacggtactgtcgtgcccaaaactgtgaacaactttgctatgctggcccatggtgttaaggcagttatcgaagggaaagatcccaatgatatacatacttactcgtaccgtaagaccaaaatcaacaaggtttaccctaacaagtatatccagggtggtgtggttgccccagatgtgggtcctttcaccgtctatgggcccaaatttgatgacgaaaacttttacttaaaacatgacaggcctgaaagactcgcaatggcctattttggacctgattctaacacctcggaattcatcatcaccactaaagccgatggaaatgaggaattggatggcaaaagtgtcgtgtttggtcaaataacttctggtctagatcaactaatggatgctattcaatacacagaaacagacgaatatggaaagcctcagcatgaattacggttcctgtatttcgttctagaaatcttaaaaattagtaacatcttagatttgcacgctgcgtacacagaaaaagtcgagaagtttagaaatggcgatgtgtctgttggctccactttggaaaacatcttccgtaacgataaagcctacacacctttaaccacctccactggaaccaccgcctatgatttaaaccacccaatttccagagccttgatgtgtttaactgttcttggcctttgtttcattgcctacaagggcatgcacgaaaagcctcatacggtttcattaagacacaagtaagcaacttcttttcgatggcttgatgaccacatggctatgattttaattaatatatatacatgacaattatttttttatacattagcgatacctaaaatttcttggttaatacccttttgacagcctctactgcattgcccttgataataatttttttcgattgcatcaccacagccatgattttttgggtatgaaaggcagttgctcctgcaagtcatttcttagttgaattacatctccttcaatctttctgatctccgtgataatcttgttacctccatttttataagcggaatacaccggtagatttccggtcctgcttctctccacgtagtaggtctttttaccaaaattgttgtttcctatgagctcatgcatcttcacgtcttccagctttggaaatattggcgcctcagcagctttatttgaattagtggatatacatcttatcgtttggtatatcgaggcagtggcaggccctggaaggcatttacccctaccaaaacatctagtaacacacgaactgatcatagttttgctcacacgctaccttggagtaagttgctttaggtaaacgggcacttctttcaaaaggttttccttcttgctggagctatactgcttatagtaccatattttaaattcataccaagccattgtacgcgatgaccattatagatcgaccttgcgacaccatcatatttaatattcaaaaagaaaaaaatgcagttctatatcacagttatataatatttatatgtgcatgtatgttacttgtctttgcacataactcaatgcgtccacaatcttaccatcttgtctttcccaccactacacactcttttaccgtcgacactccagtcgacggtataaacttcgtctttatgaccagggaggtcaacagaaagttttctagttcttacatcccacactttcaacgtggtatctttggaacatgacaccagtagtcggcagtccgatgaccacgcaacctggtatacgctggctatatgccctctaaatgtggagataaacttaccatctctaccgtcccaaagtttgatagagttatcaaaagacgctgagacaatatacctaccatcagggctgaacgccacatgattgactaatttttggtgaccggtcattcttgctataggcttggtagattttagtgggttccataaaaacatggtataatcatcgcttgcagtaaccatcatttcttctgaatttccattctttttacagattttttcataattttccaatgcctttttctgggcttcttctggtgtagaaggcttcttacctgtatgatcgaatgcaccaatgcgcaatgcgtaatctgtagataaagataagtgattaacccagtgcgcatgcgacttcaaaatgttgatacatctgccctgcgaattgatgtcccatacacgtacggttctatcgtgagagccactatacaatagaccttggccgccccatttgacacaagacactgaatttgtgtgaccactcatcgtatactggcaaactctgctcacagtgtcccaaatcttaatagtaccatccttagaagatgaagctaatcttggtttggagcccggcttcacaagatgtataggttcccaacttaaagaagtgatccacttggaatgacctctgagagcatcacctagacactgaccgctttttgggtcccataatcttatggtattgtccatggatcccgtagcaattacttctccatcgggggaccaggaaacgcagagaacccaattgtagtgaccctttagagtatgcattggcgtttgggtgtcacagtcccaaatccttgcagtattatcacctgcaccggttaccatcctagaactcgtatgtggtgcgaaggcagaacacaaaattgtggaaccgtgacctgcaatggctgatgaacttctagttaccggcttgactttgaaaactgctcttggcgtatacagtagcgtgatctgatcttctgtactgttatagcctggttttattaatgaagaatataggttatctgttatatcaatcgtcttcacagggtcactggccttcttaccttgaattgtacagctgaaggtatatggcactggatcgtctgaagtaccgttcaattgatttaaaagttcttctaactgtttctcggagatagcaccgggaactctcagggcgccacctacattgtcaccagtatctaaagcttggaacttgattgaaacattgggtaaatctttcggaataatagctacttctctgggaagttgagcctctttcttttgtttcttagaaggtggaggaatcagggtggacatctgtatattgtgttagtgtgtgtttatcgaggttacaaatataaaaatcttgtgatatatgtcttttaaagatactctttttgaagctcatcgcatttttttttttttttttcattttaaaatttttcaccggtttctcgggtaacagctctaaatgaaatcttgccttcatcaccattattgaattacattacattatatatcgtagtatatcatatttttagacgttgaccactctatgagcttaggataggtacttgatctttctctgagttgccaaatgctatttcacggatttgtatcatccaagggtctatcagtagttccacagcagtagccctcatagtggggtcttgaaccaaacacctttccaagaagggctcttcccgctgcagtcatttcgtctctattgggtagttgcggtattcgacctgcagcaacgtggtacatgatggcccattcattatccaagttagaccaaggtcgtctacctgtggccatttctagcacaacacatcctaatgcccatacatcgtccgctccaagttttcccttaactgccgagcctgaaatagtctctggagccatatacatcggtgtccccatcatttcattgagggactttgtttctactccaaaatcttgaacggctgcgttccgcacagttctagtcctagatcctacaacggtacgtgccgtaccaaaatccacatattttatgattccattgaaatccagcaagatattctccggtttaatgtcgcgatgcaccacgccagattggtgcaaatatgccaaaccttctaatagttcgaatgtgtacacttgtgttaccatttcatcttcaattcttccatgatccaataacgaggctaaagaaccaccctcacagtattccatgaagatgttaactttatcgcgatgtacttcgacaccatagtactggacaatattaggatggtttaacatttccaatacggtcatctcttctttaatcaggggaaaaatcttcttcattgttgtggtatcgtgtatctttatttccttaacagctaagatttcaccgttttccagattaattgcagagtatacctgtccaaatgttccaccgccaatgaagcttcttttttgccacctcattgatacattcgataatgaggatgctagcgatagtaggtatttgtttccctgatctgtagcatccaataccttacccatttgcctgggattcctcttcatagtcttttccaacgtctttatagcttccagtctcaacctgctgtttatttctagggtggcctcttcatcaatattctcttcagtatcaatattcaatcttgcctgttgcatgccattttcagcttcagtggctcgtgcacccataacgtcgaaatgtgaaattaataatgacatacatactgataccctctccttcagttcttgaaattgctttacattcagcgccaggatattataaccactagtcatctgcatcgcaaaatccattgcaagaacgcaccatcggaaagttcgctgatcggtaggatcacactcttcaacaaggaatttcaaccagttcattcctaatttaaccatcagaaagatgataacgtacttcctctttgagctaaaggcgttatatttaaggaaacttcttccaaaatcccttccaaacatgaatatcgaatttaacaactcatttcccggacattgcttcataaagctacctagaattcctttgtagttgttcaatactgtataagtaagtttgtaatatgccttattgattttttgtagggaggattcaattgaattgagtgaacaacgtttctctatgaatgaaacagaatcacctaccgtttgattaaacttgtcgatttgataagtcagtgcataattagaaccttgattgagtaaaatcaacgtatttgggttaccaattttccctaaatccatttcgttggatgcaaaaaggttgttacctggaagcttatatactggtccatcccaaactactggctctccaggatatagtacaactagtgcacccaatgagctcaaagcaacttccaattcaaaaacttcattgttcttttcatcaaggtgctgatcaaaagggtctgttgaaaaattcttctttttggactgatgagcatgcctgtccaaatcacttgacgaatttgctactactcggtagtaaggaattcctttggaatcctcccctttcgatactagaatgttcaaatctgtttcttttgttgttatatcatacacattcaaattatttccaatgtcaagctttgggaccaaatcacagccaatggatttatttcgcaaaattcttaagatggtatcattgtcacaacctaataattcaggagcagcaaacatatatacaccactagactcaaaagtgttaccggagtataccaaaaaatagtgagcatcttttaactttttaacaagttgtgcattatgattaatctgataaacagcagaattttggaacgccttgactagaatattgctgaacctgttcagctttcttttcatggcacccaaattttcgaaaatggaacttagccatttttctgcttctgaagcgttagcaaatgttggtgggaagttttgttgtttcaaaagatagaattgcaatttatgtacgagtctcaaagttaacttgagaaattcatttggaatcacggtttctgcaccgttaatatagtgaccggtgttttttaggtgatcccagtatttcaagagtagatcgggtgctttgaaattttgtttactggaatcaatcaactttaaattcaacagaaaaaataaataacgaatggcttctattacagtattttcgaacgtcgggtcaaaatccacatcgaacggcaaattggagcaatattttgtcagtgtgtacttcaattgcacagaaagtcgaataaaagcgttaaaatcatcgatcatttgatcgatcatcatcattgttggatttttaagctttcgtgcatatgacaatctagtcaaaataacttctttgattaaatagacggggaacgccagtagtgatcttaacctttcataaggatattttatgttcatctttgtcaaagtttctctgtagactataaaatgtagtttcagtttgaacatccaaggtgatagcggatagaaaatttttttttggaatatagactcgatgttcttttccttcatcaattgttctgcaagaatcttcattttgcagttccattggggcacaccatcaaaatcctcttggcaattatccgaactacttatcggtgagaaacggtttatccagtcgtccaactcttgcctcctcaacgttaagttcgttttaaagttcagccaagaattcattacgtctattctagcggtaaattctgcagtattggtgattggtttatccttatacatttttttcaagttaggccaataagagacaacgctgtgatatctgttcatgaggtcttgtaagatggcctccagtgcatccaggctcaatatcttgccctgtggaatttgaaacttcattatctcttcaaaaacggaatctgaactatctcttaaatatgtaagcgactgttccatctcttgcatggtcctcccattcagccatgccttcaattcgagccatatctcatctgagagctccttatttaaccctggtttcttgacttggttagcaatcctcgtcttttcacctttaacaatatctcccttcagcactctggccagcattgactgccatttgaaccgttcggtcgcaatttcattccaagctagttcatcactgtctgacctcattttcctgcaataaggtgtagtggagaaaaacttgacacctgagtgcaggtcttcatcaattctgtcgccattagacaaccgaataatttcgtcatcaccgtcgtcttcctcgtagcggttagtgagttttatgcccctcgtgtagtagtcatctaaagcggtcttttttagctttttcaagtatagcgattcattgaaaacgtatcggtccttaaaagtcagctgactggggccgtcgcttattgtttccgagccacccaatgctttcaaatcagatcttgatagtttatggctggaatgacttgataatctcttcacgagcttacttgagatggtatgaggagccagaactctcccgccttcagccgctttttgttgctgtgtattcagtatatccatcatcattttcacctacaaggaactaccttttatagccaccctaagtaaaacaacattagcttagcatcctcaattcttatcgtatgttgttgctgctatttttatcctattgttcctggcatcgcttttttacataaggtaccaaggcaagagaaaagacccgcgaaattttcaattcgagacatagggttaatacgaaatatgttaaggtctagtttccaaaaaatgaagaaaatgtgattagacatcctggggaaattaggtttaaatagggcgggcgctacaggggttttcctaacaaatttcaatgataatagtggcatcatcatcgtcatatccagtgtaggtatggactagaacagaaagcaatttgcagcaagacaatatgactacgacggtacccaagatattcgcgtttcacgagttttcagacgtggcagaggccgtagctgaccatgtagtccacgcgcaagacggtgcattggctccaaagaacgagaggaaacactctgttcccaacatcagcatgaatgcactggatatgacgagagaggcctcttgcaaaagcacagcatctgccgcggaagggaaaagtggtagcagtggtagtggcagtggtagcagtaagcccaaaaaggagaaacggttcaagattgctctctccggtgggtcattgatcgaagtgctacacgaaggtctgctaaaacgagacgatgtacggtggggagactgggacatttactttgcagacgagagacttgtacccttcagctcgaatgaaagcaattatggatgcgccaaaaggaagattttggacctgatagacacggcgaagtatggaactccgaaggtgtaccacattgacgagtcattgattgacgacccgcaagaatgcgttgataactatgaaaaggtgctaatccgcgggtttgccggtagagattccgtcaaacttccgatgttcgacttgttcctgcttggttgtgcccccgatggtcatatcgcatcactcttccctaacttccaggacaatctacgtgagaaacttgcatgggtggtgcccgtggagaacgctcctagtgggccctcgaccagaatttcgctgactatacctgtaatctgccattctcacagggttactttcgttgtcgaaggtgcaaccaaggcgcccatcatcaagaccattatggaaaggcctgaaaagggcctacctagcagtattgtcaacgaaggtgctgctggtcgtgtatcatggtttgttgacgacgatgctcttacggacgtcctcgtcaccaaaaaaaagtataaattccaccaaggtttgtctatttaaaccatgcatgtgtgtacatacatacatacacacatacatacatacatacatatatttatgtatatttatgtatatatatatatatatatatgcgtaattatgcagatttctccttgtgtgctacagcgggtactctgacgccagatcatggcctcgagatcgatatacaaaccactgcatgataaagatgaagttgaatattaaagttaccattgacagtcccacttttccaaaatttgtcacgaacgtatccagactgaaaccttgatcgttagacaactgccaaatcaattggagcagcgaggcgataccgccagtgacatctagaaacacaccctgaatggggaaacaatccatagattttcttgtcgagttatgcgtcacttgtgggatgtacttgattagtgacatcgatattttgagtaaaaacaaattgttgcaatacgccagagttcttgagttatgccaatcgtaccagtagttggagtacataaattgtacggttagcagtgaaaaaatggccagtgatgcgagtaaaatccttaggtaccatggattcatcttgcggtgacctttacctggaaatcgccagattctcgctccagctaccacctgggtcaataagacaacattcatcaagcacccatgcaggcaataccagaaatcaaattgcgtcaacttgggcctgcccaagtcagactcatcacccgtcattttccagcagtacaattgcaaaaatatggatatgaccaggtaagagtaacctgccgtatttaacatgacaaaatccatcgatatcgcgctcgctgacttatggcgccaattggtgattatcggtggatacatcgatatcgaccatgacgtaacatacacgatacctagtatatcgtctaacgacaccattttgcttcgcgtttgcttttgtttgcttttagtttttcttcccttgtttacatatggaaactcaccttaaaatttcaagattatcaaaaaatataaaggattccgctattaaagggcaataccacaacctcaaaccaaatcacctaaaccaaatcaaagatggaagcggaaaaacaatctgatattaagggaaccattgctttcgatactcacggtaacgttatagagtctaccggcgtgggcagtcaaaggatcgaagatatcggtgatttatcgaaagttacgctggatgcagaaggttttgctcaagttcaaggagattcgctactcgtacacctgtacaaacgcaatgatatcactttagctgtatataccagcgctcaataaattctttccttccctttcgacatagctatgtctgtatactatctaaaaactaaatatcacaataaacaaagtactaaaataaacacccatttaaataaagccagatcctgaccctccaaatccgccggatcctgaacctccaaatccgccagatccaggaccaaatggttcgtcgtacttggatccaggcatccatcctggcggcatatcttcccgtcttggggcaggtcttctatttggatcgaaaatcataccgccttggctacttggattccccagaggattgggaagccctccagaccaatccggatggcttgtgccaacaggatacagatcaccatccgcataccctcctgctgggttagcgaagctcggttcagttaccgtaagtccgggatatgggttcaacggtgctgttccctggttttgtcttgcttgtgcctggtactcatcgtcaaattttggcatgtccgcactacctgcagtttgtcttttaagttgtgtcattataggtttcaggtctggctccacaggtaagctttctctttctagtggccatttcaattctgtgggcaatttaaaatcgctgtaacccaccacacatgccatggtgatcgacgtaccatgacgaataacaacagtatacttgtcattgtcatccagagtctgaatcaccactagctcagagagaaacgatgttgaacccttctcactgggagaatctttaatgcgaaaactcacttggcatgatttggttccctctgtatggcgtgacaccacctcagttttaccgatggactccaacactagttctgctaccagttcaaccttattctcaatcattgtttaactcttgcgttactatggtggtattattgatgctaatacgggttttttatgaaaaaaaaaggataacaaacttatataaacttatataaaaacatatacaataaatgatctacaaagggtaggaaataaaaaataagggagaaaaaaaaatacatgcgtaagtacattaaaattacaggaaaaatcttactttagttctgatatttcaccatcgcgatacaccaaccccataacgtttaggaacaaattcaaatcttggtatagtttctctttattataaataatagattttaactctgtgtctaattcttgagacctctgaggtaatacactcaattctttctctttcttttgtaaggtctccgcctcgttaatagtggcaaagatttcatcacgtacttcatcaataatgattctctggtggtttagctttccacttagtgctaaactagctaggaactggccaaagtatgcttcatccataaacttgtcattttgtaaacgcatgatgtggacgttatattcccttggagggaaaatcagctgaatcttactttccaatgaagtgaataatttatcataaatctcattccatgtggagatttcaggagaggaaagaatattagatcttgatgaatcttgcttgattaatgcggcacgagaaatcaaaatggtgatcaaatttagaccaattttggaggtggtcaagaacgaaacgttgttgtttctgattaactgtagcaacagacccataatttcgataaaattggagttattagacaaaaacgagacaatgatctttaatatgatcatttggaacagatcgactttcttcaattgtgtcaaagttggttttggtgtagtcttgtaggaactcaatatgatgatttgcaagtgtgataattcattgaagattttttgcaggattttcaatttttgctgcttatccaagaaattaaaaattctaggcataatcttgatacctttatcaaatgatagcatcgaaatgaaagggtttacgtcatatgaactgtcgtcgatgtgaagggcctcccacattgcagtgctgtcagtttgctggccattcctcaagttagcttccaagtctaaaatctcttcataaactgtttcaattaactcaagaatgaattttttgcccccagatttgttcaaatttgtggcaccattaccgttgttgaacgcgtatgaagatcttcttctttgcttagaagcaacagcagcggcagaagagcccgtagaggaggaccctgaagaggccaagtccacgttggtcagagagtcagtgacgtcttttagcgcatcggggtcagaagaaggctgttgtctggggatctgcagttgtcttcttggattcttgctgttcaaagtggaagagattttgcccagaaccgtgtttgcttgcttattatcctggctagagttaccagcagccgcttgttgatccttcaacttagaaggtctttccttagccacagtgacagccttttctacttgactttgcattctctgtagggcaatatcggttctcttatagcgaccaccgagtctgtgtccagaatgttccaaatacgccctagcaatcaaacctttgttggattcggacgtgataccgcctctttggataatcttgtagacctggaagtagaaatcctcattgtaagggtcctcagtgacaatttgagacaactgatatctggtgatgaagtccttatcacgaggagtcattaaacctgagtatttcaagattttctccactttggcatgacgaatctgcaaacgtctttgctcttcaggcgacaaatctctcttcgatctgcgtccactttgcagaggcattttagttgcgccaaccacagggcctggagaaggagtgttggacataccgatgggtgaaggcgaagcttgaactggaacttgtacaggacccattggcatttgattcatattcacattaacgccaggaggtggaggtggaggcgcaaattgtgagggacctggttgacccgacgcaggctgcattggaaattgctgctgaggcggaccctgtgggagaccctgtggatgacccatggcgtggaaattcataaactgttgctgcatttgacgttgttgtctttccaagtcttgcatcgacaagattggctgtaggggggccatttgctgcggagcaggagccggagccattgtactttggggtgaaggcgccattgctggaggtggtgcagtagaccacaaagattccattggcttcaggtctagaggtcctgctgctgccgttccatcggtcctagggccgctaattccttctgcagtagctgcaacatatgatctagccgtggcaccgacgccattaccaccaattgcgttgccgctgctgccgctgctgtgaggatttccaaaatcaaagtcggtaccaacctgaacattatcaccaaatgtttcgtcgttcaaatagtcgttctcctcaagttcgtgctcgccatagcccttgtaactctcttcaaagtccagaggaccatcccgcgcattaccgctattttctaacccaaagaaggacattgctagtgcttcttgctgctcttacttccggttaaaacctttgcttccttcaaggtgtacatgtttcttttcattcaccttgtttctttctttaaaaagaggaagaggaaaaaaaaaatttcgtgtaatgcgagaagaacaaatagggaagtgataacaatagtatcaataacaggctgcaatcggggcaattaagcatcagaagaggggaatttgatgcggctggggaatgcttatgcgtattgcaagccgtcgcaaaatgttgggctgaagctggacttgttacggggtcttccagggtacgtgggtcacgccacgagtaggatcaaccggttagagaaccaggacaattactccattaaaatgatgcggtcgtggcctaatgcgtatggaagtgccctgaactgctctgtattcgatggccatggggagaaaggtgcgcaactgtcacagttgttagccgataaattgtgcagtagcctggatttccctgaaccctcctgggacaagcaggacttgaagaagttggtacaggaatatgcaagaaggtttcccgagggaaattactggaaacataagctgtccacgtttgaaaaattctacaacaagtttataaagaactgcaactcgaaacaagaactgctgctgatgaaggagggcgatagtgcgatccttggacaaaatggtggcaggatgatttttgataaaatggggaatattattgacaaaattgcactgctcactgagctagaccgtctgcgattgttctacgggtttgccaggttcgatctcgaccaatgctgcggcctgggcaccgcagcggggtccacagcgtcgtccatatttctatatccgtatgatgatccgaatgcacccattgatgaggggaaagacgatgactcgtggatcatatcgcactctggattgctcaaactcattgtcacgcaggtgggcgactctaagatcatcctctgcgatcaagacgggattgcacacgcattaacaacaactcaccacatcaattccagtagggaacgacaccgtttgagcatagacccttctcgattggacccagacgcctttggagagacaaggtttttgaataatttcgccaacactagatcgtttggtgatgtcgctgggaaaccgtatggtatatctagtgagccggatattttctcgtttcttgtcggaaataccttgcatttgccgcgatctgaaaggtcgaagctgcccttcaatggtgatgaatgcttcctggcgcttgtcaccgacggcatcaccaataaacttgcagaccaagaggttgttgacctcatcacctctacggtgaactcctggggactgaaaaaggcgactcctcaatttgttgcagaggagacaatcaaatttattcaggcaatagccactaaacactcagacaacgccacttgcgtggtggttaggctttccaattgggcaactggcccaatgttgacagaactggccccaaagagaaaccaaactaatgaatgcacaatctaacgaaacaaaattaaactaaacacccccctgggtgaaacaagtcctagataatcatcttttgtattttttttcttccttttattagtatgtatacatatatattactttttatattctttatagcgcattttaaacacctttctgaaaaaatgctgagatttttgatgctaatcgaaagattaaaaaaaggtctatagaggtaagccaataacgcgatgaataacggttctggtcgatacttgctgactcccccagatgatcttcacccctatgtgccaagctcgaaacctcaggaacaagtataccctgatttcaagccttgggagcacactgcagcagaagatcaaatcctagcaaactttgtggctaagggcttttaccatacaccaatggtaaatttcgagtccatatctgcgagatcatctgttcatgaatcattagtcactcaatccaacattctttcccagcaattcgacaaaattatcaagattagagaagaccacattaataagatcccctcaaattccacgacgacattacacgggcctggttttcagttgcctaatagaataacccttactgatcatagaaaggaaacgtggttgcatgaattgagattcgtctcacacttcgactggtcaaaattggcaagtttatacctcacggcttgaaaagaaggcaagtcatcgagcagtgctatttaaaatttataccattgaaaagggcgatttggttgataaagtgctgctattttatcgaatggaaatcgaaccagaaaaagaagaggtcaaatgctgctggggcagatgatgccatttccatgcacctgctaaaggactggacggatacctttgtatacatcctggaaaagctcatctttgatatgacaaatcactataacgattctcaacaactgcgtacgtggaagaggcagatttcttattttttaaaacttttggggaattgctactcactaagattgatcaataaggaaatctttcatcattggcttgtagagtttataaataagatggaaaacttcgaatttttgccattatctttacatattttgatgattttttggaacgacatctgccaaattgatacaaatgctcctgttgcggctacaataacatcaagtcaaaaagagcccttctttctggtaacaaaaatcactgatatgctattgcacaaatattatattgtttccagcagcaaatcaatgataaatgacgagaactacatcatcaatgatataaagaaaaacaacaagataaagttgaatattctcaaaatattatccagtttaattttgaaaatttttcaagaacaatctttagaggtgtttatatttcccacatctaactgggaaatttacaagcccttactttttgaaatagtctcaaacgccgacactaatcaaaattctgatatgaagaaaaaattagagttaattagttacagaaacgagtcattgaagaataattcttctatacgaaacgtaataatgtctgccagcaacgcaaatgactttcaattaactatcgtcacctgtaaacaatttccaaaactatcatgcattcaattaaattgtatagatactcagttcaccaagctactggacgataaccctacagaattcgattggcccacttacgttgaccaaaatccccttacaatgcataaaattattcaattaattctctggtccatacatccatcaaggcaatttgatcactatgaatctaatcaactggtagcgaaattattactattgcgaataaattcaacagatgaggatttgcacgaattccagatagaagatgccatttggtcattggttttccaattagccaaaaatttttcggcccaaaagagggtggtatcatatatgatgccttctttgtatcgcctgcttaatatactaattacttatggcatcattaaggtccctacgtatatcagaaagctaatcagttccggcctactttatctccaagattccaatgataagtttgtgcatgtccagctgttaattaacttgaaaatttcaccgttgatgaaaagtcaatacaatatggtattgaggaacgttatggaatatgacgttaaattttatgaaatttttaatttcgaccaactcgtggaaatcacagaacaaatcaaaatgcgaatactctccaatgatataactaatttgcaactgtcgaaaactcctctgagcattaaaatcatggttgcagaatggtacttatcacatttatgttccggtattttatctagtgttaaccgcacagtgttgctaaaaatattcaagattttttgtatcgatctggaggttttccaccacttttttaagtggatcgagtttattgtctaccatcaattgctaagtgatatagaatctctggaggcattgatggacatcttgctatgctaccaaaaattgttctcacaattcattaatgaccatattctttttacgaagacgttcatattcatttacaagaaagttttgaaagaaaaagacgtgcctgcttataatgtgacttcatttatgccattctggaaattttttatgaaaaacttcccttttgttttaaaggtggataacgatttaaggattgagttacaatctgtttacaatgatgagaaattgaaaactgagaagctgaagaatgataaatcagaagtcttgaaggtgtattccatgatcaataattcaaaccaagctgttggacagacttggaattttcccgaggtgtttcaagtaaacatcaggtttctactacacaactccgagatcattgatacaaatacaagcaaacagttccagaaagcacgaaacaatgtcatgcttttgattgccactaacttgaaggagtacaataaatttatgtccattttcttgaaaaggaaagactttactaacaaaaatttaattcaattgatctctctaaaacttctaacttttgaagtgacgcagaatgtgttggggctcgagtatattattcgattattaccaataaacttggaaaataatgacggctcatatggtctgtttttgaagtatcataaagaacaattcataaagtcaaattttgagaaaattttacttacatgttatgaattagaaaaaaaatatcatggcaacgaatgtgaaataaattattatgagatcctattgaaaattttaataacttatgggtcatctcccaaattacttgcaacatctacaaaaatcattatgttgttattgaatgatagcgtggaaaactcatctaatattttggaggatattttgtactactcaacttgtccgtcggaaaccgatcttaacgatattccattgggtagtggacaaccagacaatgacactgttgtaaccaacgatgataaaagtgacgatgatgatcacacagtcgacgaaattgatcatgtagaatattacgttatgatggactttgccaatctttgggttttccaagcgtttacctgtttctgcatcaaaaaaatcatggagaataatgagccagcaatggcaatggaagacttgaagaacttcatattccaaattatcgaaataactaattctaatgatttatgttcacaaatatttgaccaactgaaggatatgcagaccattgagatgataacccaaatagtggagaaagatttctgcacttcttgtttgcaaaacaacaaccaaaagatagatgataattacatcgttgtggtgatcgagattataacgtcattatcgatgaggtttcaaagagaaacttctggtatgatagttatttccatggagaactatcatttactaataaagatcataagacaattaagtgaactgaacgaaggaaatttatctaagagagaaatccaaatagatgccgtcttgaaaatttttagctttcatcaggattccattttccaacgcatcatcgctgatttatcagctgataaacccacaagtccattcattgatagcatatgcaagctgtttgataaaatatcatttaatttaagattgaagctgttcttgtacgaaattttgtcttcattgaaatcattcgccatctattcatccacaattgatgccccagcattccacacaagcggtaaggtcgaactaccgaagaaattgctgaacttaccaccattccaagtgtcctctttcgttaaggaaacaaaacttcatagtggcgactacggggaagaagaagatgcagaccaagaagaatcgtttagtttaaatttaggaatcggcatagttgaaatagcgcacgaaaacgaacagaaatggctcatttatgacaagaaagatcataaatatgtctgcacattttccatggagccgtaccacttcatctccaactataataccaagtacacagatgacatggctacaggcagtaatgatacgactgcgtttaacgattcctgtgtaaacctgagtctttttgatgctcggtttgagaggaaaaatccacattgatctcagaatatatccaaatggataaattataaatttaccaataacagtaattatgtgtcagttttaatacccaaccaattgattcctctaaatgataccgtaccaaatgacatgtttgccaccgattataaaactggggtttatgagcgatggttaaggaggattaagacaaagtgctcatccgcttacaagatcagtactagcgtgtaccagtctatttaaactggaatgatcaccccaaagggaacgcacgatgctgtggccaagtttcaaaaaactgacctgcatcaagatctcgattacatcgtactgcaacaacgaagaacacagctagagacgcttattaacgaaagagaatcttttgtcaagaatctgtgttctcttttccacaaaattcaaaataccaagaattaccaggaatttgttgatgtattggcggagaatagggatttactgcgagaaattttcactgtagagaacggatttcaaaagcaaaaatggattagcaacgacgacattccccagatagactgggacaagtttgccctagatatcaacgcttatatagcagagaacgatcaattgttggctttgtatgaagatggcttattatgatcaaatagcggctatggacatttttaaacatatatttatatatatatacatatatgcgtatattgcataaatcacaaagaagaacaacgccctagatatagtgacccaaaatattatgtttaagttactggttggggttcatgtacatttttcactatcttttaattccaaatgtggattgtgcttctgcagattttgttgcctagtattctgtgatggaaaaaattgccccgatgagatataaaatgagctagccccctaaccaaagaaagcaggattggttagtacatagagaaaccaaagctgttatgttgttctataagcctgtgatgaggatggcggtgagaccgctaaaaagcataagattccagtcctcatacaccagtattactaaattgacgaacctaacagaatttaggaatttgatcaagcaaaatgataaactagtcatcgatttttatgctacttggtgtggcccctgtaagatgatgcaaccacacttaacgaaattaattcaggcttatccagatgtaagatttgtcaagtgcgacgtggacgaatcaccagatattgccaaagagtgtgaagtgacggctatgcccacctttgttcttggcaaggatggccaactcatcggcaagatcattggagctaaccctactgctttagagaagggaatcaaagatctataaattttatattcatgagcacatgtagtttttttttttttagttttaaatataagaaaaaagatagtatatatatatatatatatacatatacatataaaaggaaagtaagcttatacaatacacaaataaattcatatcaaagaataatgaaccgcaatattcagaaacacaggaaaaggaggggaagggatgaatggtgaggaaagtaactgtttgttttaaagcgtacctggatcataacataacaaataagtagataaaaaagaatagagagaaagatataatgacaatgaattgaagaatagtttagttagttacatttgtaaagtgttccttttgtgttctgttcttaatttggcgctatttttttatacttccaaatccttgctttacaatcaccgctaccagtagcaaaaacgttatattctggacccagcggagacccgtttgccacagccacagatataactgaattcctatgaccttgcaacatcaataacggattgccggatttcttatcccaaaacaggacaccacgatctttggaaccggacaagatgtactcatcattttgtgtggtggccacggacaatacaaagtctttatgcccgatatacgtaacttcacaagtgccggaatttggagttttcgaatcgctcttgttgtttgcattctgcaaattccagagcttaacagatctatctaatgagccggatacaacgctttgtccatctctagtgaagacaacgctataaacagagtccttgtggcctgtaccggattcgttttccgaatctagtctttccaccaagaatccggtctcggaatcccaaactctcacagcacgatctagagaaccagcagcgatgtatttaccatcacctggtgatacagcgacggtggtaacaccatcttcaatggataaagtcaatgaacactggcctgtacgtaagtcccaaatacgaacggtacggtcaccagaaccggagactaatttgtcacctgagggaaagtagtccaatgaataaatatcttgttcgtggccttgaagaatcataacaatctttctattttcaatatcccaaattctaatcagtctgtcttcagcacctgttgccaaaaatttcccatctggagaaaaacacactgaacggatatacaagtcggatgatggggaagacgaagtgttcaggttttccacatcttttgccaattctgctgccgaagtcatcgctgtggtagtaattgtggtggtagtagtggttgtcattgtattgttatccgtggacgtggtggtgttattttcagtgatcgaatttcgatggttattggcagcagaatcgtcagatagacgggccaccagagaaccatctgaaacgcgatacacttgagtagttttgttgcagcctgtggctaagtattcaccatcgttactgaacttcacgcaacaaacaactgaagtatgatccaaagatttgtgtaactcaacgtcaatttctcttggtagtgccgggttgtataaaatataataatcatttgtttgcttcttcagagcatcgggaacagactgggaatctagatccaaaaggaaaggtgggataggtttagagtggtttgctctttgattataagggactaagtagtgatcctggtgcaaactagccggggtggcgtcttcctccttaggtttgatttcagtttcagttgcggtggtagtggtggccgtggtggcggatccggtgtcatttatcttcgaggtattattattttccggttcagtttctttcaacgtagattcaggtgccttgacagagggtaaagtagtggtctctttagaagtaggagatccgttgatggctgtgttactcaatggtgccacggaaacctggggaggtggttgctgttgttgaagttgctgctgttgcagttgctgttgtggtagttgttgttgggcgtttgaggacaccacaggcaaagtggtggtaggcaactgtgagccaaccagattaggacggctagcttgtactgggaaggccgatggcgaaccagtagttgtgtttgctgctggagtggcggtggccgaagtagtagccggtggttgttgcgcaactggaacagatgcagatgcagcggctagctgctgctgttgctgttgtaaatgctgctggacctgttgctgctgttgctgttgccgctgttgctggacggtcaaagatgcaatttgatggtctctttgctccagccctagtttcaagtgcttgatctcttcttcgtacgcgtccttcattttcctgtgagttagttccagttcgtagacggtgtttcttatctgctgcatctcagccagctgctggttcattttgaaatcgtaatccttttggttttgaagacggtaggtatttgcctcttgtgagacttggagaaactcctgtctgatggcatcgagaagctcattcagcttattctgcgtattcgaaacgctggcagtcatattggtttggatggaaagctgatttctttcttcccctgcttatcaaaaaagacaaaaaaacaatagaaaaagagtagtggtgtgcgaaaggtaacttggcgtgaaagaaaattaaacaattgcagaaggacagatagaggggcacgtgttcagccagttgttcttgcttcgctgatgtttatcaattgggggtagatgggggaatttctctctatttgtttacttatgtacttgttattttgttttgttgtttgttgctttgacgggagagctttttaattttttcgcagtttttcagtgttttttgaaaagtacgaaaaattaaggtccgtcggtagcgataatgtaagagggttctgtctctaaaaatgttagggtgaaagttccaaaaaattattaactcctagattgctcagccaaaaagaagggtaaattagggctttcctggtttatttatttgtttatgttgttcttatatacatatgtttatgtctttttatgtacaaataatgatgtttacaatgaaacatctgttatgctatcaaaaacgtcagcgcattgttttatagctgaagaagttacaacggataacggtctgatttgcggcctggcaatgcttggtaaaactaaatatcaattttacgaattatttactgtatatagtattcagtccctcactcaactggcgtcaagagtgaagaagggcggcctcattatggctcgccttattctgttcaccctctgcgctcttcccgtattatttcattttattttgtttatgcttcaatatcttgtatttgtttacattgaaaaatgattggaaaaaggtcacattgaaatcaaaacagtgaagaagcagacagacaagaaggtcattagatagataaacaggaacaataaaaaaaagaaagcgaaacaagacaatccaacgtgcgcaaaatggatccattgactgtatacaaaaactcagtgaaacaacagatcgattccgcagacttactagtggcaaatttggtaaatgagaatttcgtactgtcggagaagctggatacaaaagcaaccgagatcaaacagctgcagaagcagatagactcgctaaacgcacaagtcaaggagctgaagactcagacttcccaacaggcagaaaattcagaagtcataaaggacctttacgagtacctctgtaacgtacgtgtacataaaagctacgaggatgattctgggttgtggttcgacatctcgcagggcacccactcagggggatcttccgatgattattcgataatggactataaactcggatttgtcaagggccaggcccaagtcacagaagtcatatatgcgcccgttcttaaacagcgatccaccgaggaactatactcgctacagtcgaaactaccggaatacctcttcgaaacgttgagtttccccctctcgtcgctaaaccaattctataacaaaatcgctaaaagcctgaataagaaaagagagaaaaaagatgaaaccgagtaagctgctacataatgtctatatatctacacataaaattccgattattcctttgcatacctgatttgcccctcagaatccacaaccagacttttcaagaaggtcttttttgcccctttatccttcatggttttcaaaattttgtacaacgacttgcccttgtgaagctcgataccgttcgaggtcttttccactttctctgccttcttgatcacaggcttctccactttctttgcaggagttgccactggctggtgctggtgctgcttctgctgctgcttctgctgctgcttctgcttctgcttcttgttgcccttgtacaacgctttctggtacttctcgtcctcgctgatgcaagacgtgtgattcttgtaactcacgccatcttcaaacgtcttggagcaatctatgcatgtatagtacgcgttaggacatctataataatgcttttcggtattcttcttgggcacagtatcattacacacctcacagttgaacgtaaccatcctgtaataacaaatatttcttgactgagaccgtttgctgttgtatacagaatactcttagagctcatcgcaagttaaaaattttcaattttttttcactttttcccgtcaaggcaaaaagcaaccaaaagagaatgaacctttatttttgatttatttattatgagatgctgctagtccactcatctgcatcaatgtagtagtcacaaagctaatatttagacgttactttgatatctctgtccatgagagcacttattttaggaagttaaatgagacagtcaatagttcacaatatcccgtcagcaatggagggaaaaggcattccttttccataggattttaatcgttttcaagcatcatacgccctcgaggaactcttgttttcgctttactatgcaaccattgatgtatttctgtataaatgtgcgtcacgtggccttgtgtctcttatttccacttgttttttcacaatgcggaaaacctcgattaaagtagaaaaaaaggatataataggagtataccatattggatagttcaatctataaacaaacaatcgcataaccgcacgtatatacacgcacacacctatcaatcacaatggctttggaacctattgattatactactcactcgagagagatcgacgcagagtacctgaagattgtcagaggctccgatcctgacaccacctggttgattatttcacccaatgcgaaaaaagaatacgaacctgagtctaccggttcctcctttcacgatttcttgcaattgtttgatgaaaccaaggtccagtacggactggcacgtgtgtccccaccagggtcagacgttgagaagattattatcattggttggtgtcctgattctgcgccattgaagacaagggcctctttcgccgccaattttgctgcagttgctaataatctgttcaagggttaccacgttcaagttaccgccagagacgaggacgatcttgacgaaaatgaactgttgatgaaaatcagtaacgcggccggtgcccgttattctattcagacttcctccaagcaacaggggaaggcttccactcctcccgtgaagaaatccttcacaccttccaagagccctgctccagtttctaagaaggaaccagtcaagactccttccccagcacctgctgctaagatttcttcccgtgttaacgacaacaatgacgacgacgattggaatgagcctgaattaaaggaacgcgacttcgatcaggctcccctgaaaccaaatcaatcatcttacaaaccaattggcaaaatcgacttgcaaaaagtgattgctgaagaaaaggctaaggaggacccacgtcttgttcaaaagccaaccgctgctggttccaagattgatcctagttctgatatcgctaatttaaagaacgaatcaaaattaaagagggactccgagtttaactcctttttgggcaccactaaacccccctccatgacggaatcttcattaaagaatgatgatgataaagtcattaagggttttagaaacgagaaatcacctgctcaattatgggccgaaagaaaggcaaagcaaaacagcggcaacgccgaaactaaggctgaggcaccaaaacctgaagttccagaagatgagcctgaaggtgaacctgacgtcaaagatttgaaatcaaaatttgaaggattggccgcttcagaaaaagaggaggaagaaatggaaaacaaatttgctcctcctccaaagaaatcagaaccaactattatctcaccaaaacccttctccaagccacaagaacctgtgaaagctgaagaagccgagcagcctaagactgattacaagaagatcggcaacccattacccggtatgcacattgaagcggataatgaggaagaaccagaagagaatgatgatgactgggatgatgatgaagacgaggctgctcaacctcctttgccttcgaggaatgttgcgtcaggagcaccagtgcaaaaagaagagcctgaacaagaagagatcgccccaagcttaccttctagaaactcgatcccagctccaaaacaagaagaagcacctgaacaagcacctgaagaagaaattgaagaagaagctgaggaagccgctccacagctgccatcaagaagctctgcagctcctcctccgcctccaagacgagcaactccagagaaaaagccaaaggaaaatccttgggccacagcagaatatgattacgatgctgcagaagataacgaactgacctttgtggaaaatgacaagattatcaatattgaatttgtcgacgatgactggtggctaggggaactagagaaagacggctcaaaaggtctcttccccagcaattatgtgtctttgggcaactagaatcacacgtcagcgtcatgctattatattattcttacgtaaaaaaatacttacagagacgttaaagcttttgtatagatactttcacgagccttccctttcagtaaaatgaacaaattattttgccttgtccttctttgtttcaagcgtttatatgactcctctacagtattatttttcaacagacggtgtgcccgtacggcattgtcaaaacctcgaacataaaacaacactgaaacaaacttattgcactcctgcatcgcatacagatctgatacttactacaaccataatgctgttttagaatcgcatcaggtgtttaccagaagtgtatggtacatggtgctttccttatgctcactatttcggatttacttctagtctatgtatagatttgttagagaccagttttaagctacaatggaacgttaagattaagaaatgcatgaagagtctcccagtagatatataaagctgaattaaattcagtacaatggaagtttccacgtctttctgtattttcatacctttaattataggaaaagcacactacaaaaatacgctatcatctaccgaatataactgcaatgaactcatttgcgtcattaggtctgatatattcagtagtaaaccttttaactagagtagaggctcaaattgtgttctaccagaatagtagtacttcactgcctgtccctactttagtatccacctcaatagcagattttcacgagtcctcatcaactggcgaagtgcagtattcatcctcttattcgtatgtgcagccctcaatagactccttcacttcatctagcttcttaacaagttttgaagctcctaccgaaacttcttccagctatgcagtttcttcctcattgataacttctgatactttttcttcatactctgatatcttcgatgaagaaacaagttcattaatatcaacctcagctgcctcatcggagaaagcctcgtccaccctttcttcaactgcacaacctcataggacatctcactcttcctcttcattcgagctaccagtcactgctccatcatcctctagtttaccgtcctcaacttcattgacatttacgtcagttaatccatctcaaagttggacttcatttaactcagaaaaatctagcgctctttcctcaaccatagattttacttcttctgagatttcaggttcaacatctccaaagagcctggaaagtttcgataccaccggtactataacttcatcttattctccttctccttcttcaaaaaattctaaccagacctcactactcagcccattggagcctctgtccagttcttcaggagatttaatattgagttcaactattcaagctactaccaatgaccaaacttcaaaaactattccaactcttgttgacgccacatcgtcattaccaccaacattgaggtcatccagtatggcaccaacaagtggttctgattcaatctcacacaactttacgagccccccctctaaaacaagtggtaactacgatgttttgacttcaaactcaatagatccttctctatttacaactacgagtgaatattcatctacacaattgtcgagtttaaatcgggcctcaaaaagtgaaacagttaatttcactgcttctattgcttccacaccatttggtacagattcggctacttctctaatagaccccattagttcagtgggttctacagcatctagctttgtgggaatttcaaccgccaattttagtacacaagggaactcgaactatgttcctgaatcaactgcaagtggaagttcacaataccaggactggtcaagctcttctcttccgctgtcacaaaccacttgggttgtcatcaacacaactaatacacaagggtctgtaacgtcaaccacatccccggcttatgtttctacggccaccaaaacggttgacggggtgatcaccgaatatgttacatggtgtcctctaacacaaaccaaatcacaagcaattggggtcagttcgtccatttctagcgttccacaagcctcctcatttagcggtagttctattttgagctccaattccagcactcttgctgcctcgaacaacgttcctgaatcaactgcaagcggaagttcacaataccaggactggtcaagctcttctcttccgctgtcacaaaccacttgggttgtcatcaacacaactaatacacaagggtctgtaacgtcaaccacatccccggcttatgtttctacggccaccaaaacggttgacggggtgatcaccgaatatgttacatggtgtcctctaacacaaaccaaatcacaagcaattgggatcagttcatccacgattagcgccacacaaacctctaaaccatcttcaatattaacattggggatatcgaccttacaattgtctgatgccacatttaaggggactgaaactataaacacccatctcatgaccgaaagtacttcaatcacagagcccacctattttagtggcacatcggatagtttttatttgtgcaccagtgaagttaatcttgcgtcttccttatcttcttatccaaatttttcatcttcagaaggctctacggcgaccattactaactctaccgttacatttggatcgaccagcaagtatccatctactagtgtatctaacccaacagaagccagccaacatgtgagctctagtgtgaactcactcactgattttacttcaaattcaaccgaaaccatcgcagttatatctaatattcacaaaacttcgtcaaataaagactattcattgacgactacgcaattaaagaccagcggaaagcaaacgcttgtgctttctactgtcacaacaacggtgaacggtgctgctacggaatacacaacgtggtgcccggcatcaagtattgcttatacgacatccatatcatataaaacattagttttgaccactgaagtctgctctcattctgagtgtactccaacggttattaccagtgttactgcaacaagctctacaatcccccttttatcaacctctagctctacggtattatcttctacagtatccgaaggtgcaaaaaatcccgctgcttctgaagtaactattaatacccaagtttctgctacttccgaagctactagtactagcactcaagtgtctgctacttctgcgacggccactgctagcgagagttcaaccacatcccaggtttctactgcttccgaaactattagcactctcggtactcaaaactttaccactactggaagcttacttttcccggctttgtctactgaaatgataaatactactgtggtttcccgaaaaaccctaattattagtacagaggtatgttcccattccaaatgtgtcccaacagtcattaccgaggttgttacttcgaaaggcacgccttctaatggacattcttctcaaactctacaaacggaggcagtagaggtgacattgtcatcccatcaaaccgtaactatgagtaccgaagtatgttctaattcgatttgcacaccgactgttattacatctgtgcaaatgagaagtactccttttccatacttaacttcttcaacgtcaagttcctctttagcctccaccaaaaaaagttccttagaagcctcctcagaaatgtccaccttttctgtcagtacgcaaagtttgcctttggcattcacttgttcagaaaaacgctccaccacatctgtctctcaatggtcaaataccgttttaactaatacaataatgtcctcttcttctaatgtcatatcaacaaatgaaaagcccagtagtactacctctccatacaacttctcttcggggtactctttaccttcttcttctacaccttcccaatattcactatctacagctactacaacaatcaacggaatcaaaactgtgtacacaacttggtgtccattggcagaaaaatctactgtagctgcttcttctcaatcttcccgcagtgttgacaggtttgtttcgtcgtcaaaaccatcctcatctttatctcagacctctattcaatatacattatctactgctaccaccaccataagtggtttgaagactgtatacacgacttggtgtccattaacaagtaaatcgactttaggtgctactactcaaacttcctcgacagccaaagttagaattacttccgcttcatctgcaacatctacttctatttctttgagcacttcaacagaatcagaatcttcatctggatatttgtcgaaaggagtatgctcaggtactgaatgtacgcaagatgtgccaacacaatcatcctcacctgcttcaacgttagcatattccccctctgtttctacatcatcatcatcatcattctcaacaacaactgcatcaacactaacgtcaacacacacctctgtcccgttattaccatcatctagctctatatcagcatcttcgccatcatcaacttcgttgttatccacttctttaccatctcccgcttttacgtcatcaacacttccaacagcaacagcagtatcttcctccactttcatagcgtcttctctaccattgtcctctaaatcatcattgtcgttatcgccagtctcgtcgtctattttgatgtctcagttttcatcatcatcatcatcatcatcatcattggcatcgttgccatctctttctatatcaccaactgttgacactgtttctgttctacaaccaactacttccatcgcaacactaacttgcacagactcacaatgccaacaggaggtatccactatctgtaatggatccaactgtgacgatgtgacttcaactgccactactcctccatctacggttactgatactatgacatgtactggatctgagtgccagaaaaccacatctagcagctgtgatggttactcgtgtaaagtatccgaaacgtataaatcaagcgctacaatatctgcatgtagtggagaaggatgccaagcttccgctacaagtgagctaaattctcaatacgtcacgatgacgtctgtcattaccccaagtgccataacaacaacatcagtggaagtgcattcaactgaatccactatatcaattactacagtgaagccagttacatatacatccagtgatactaatggagaactgataaccataacaagttccagccaaactgtaattccatcagtaacgacgataataacgagaacaaaagtggccataacttcagcaccaaagccaacaactacgacctatgtcgagcaacgactttcctccagtgggattgctacttcttttgttgctgctgcatcctcaacttggattactacacccattgtcagtacgtatgctggttcggcgtcaaaatttctctgtagtaagttctttatgataatggtaatggtgatcaacttcatttaatttcccgtatatattatatgtacgtatatatgctataaacagacactctttttacttacctttaataatgcttgatgagaaatcagtcattgttacttcttccccaaggttgtcatcataatcataccattcattatcctctagttggcatgacattactttccccgaacttagagaaacttcaaacgttatggtgtcgggataaaatttgattaattcacaacctctgcaatcaaggcttaaaggaatgaaagaatcttctttgaccttcgataaaccatgcttcttccgcacatcttttatcttggcccatttgtcgtcactctgatcagttaaatattcatcctcaaaagcgcacaggttaactgacaattcttttgaacaaaatttacacttcatcaagaaagatgcggtaccttttgatgccggcatagcatattcttcaaatgtattgatgatgactttagaatcgtgtaattctctacaactggtacattgtagatcgaaggcaaattctgcccttgattcgtttgtattctcaattgaaaccttggtcacgttttctgataatgttgctttcagaaccaaaaataacggcattatcgtacacaacctggttttctttattggttaagttgtctttattcaaaatttttcattacttcttataaacagcttcttgacgcttgtaatttcataagtttttgatacaagcaatggaaacaaaattaagaaaatgtaggcaacgaagaactaaatttgaaaaaaaaaaaaaaaaaaatttactgccaagatcatctaaattatcttatagtagcaaagcttgagcataaaaggatcaatcttttagttttttatggcaaagtacatttgcagtaagtaattagtgatgagataaacaaagaataataatccaattcgaaatcaaaaattcaaacaacaaaaaacataatttcacatatatatctaattcattcacgaaaaacacgtcagttccttctgtctgttgtaaataggatgcatccgcagtgaatcatggaaatatttcaaaactttcagcccaatcattttatttggtcaatgaagccataaacgctccgtaattctaagattaaaaaaaattcataaaaataaggaccaatataaatatatatatttaatgtgctagtgacaatcctagtgataaaattgcaaattatactacaattggtcatggtgaagcctaaacacaccattacgtcttcacagtgttattcattttattttcaaaggtatgctactactaatgcaccagtgtataccatgatacggtgaaaagggcatgtaatattgcgttaatttgtcgataacctttctttacgtttaaattttttttttataactggcgacactaaacttctcgataaaatacaacataaaaagcagtacctagctaagcgaacaacagataataaatagctaaacatctaggttaatagccaattagcaatacatttaaggattgatagtgtggtatttacaaggtaatagcccgctaggctataaggaaactactctaaattcaccttccatatatgtgactgccaagaaaatattactagttatcaagctttttttgtgtgcattcaacttcaacgaatccttcgtcatcaatgaaacaaaagaacaagccagaactgaaaaaaaaaaatcaaaaccactaagaatgtcacatccttccaaaactcctgctggctcttcaactcttcaaagaatatcaagataaatatcattatctccagtgtggccgacccatgcatgagtgcgaggagcattaagttggatcctgggaaaacatgtcaaggacattcaataaagtacttttcatactacaacagacgctagaagaactagaatgtaaccgtgaactgcctctcaaacacataattatgatagcgccgtcttcggcatcctttttcggaaatatactttcctttttccctctttcagctatattgttcaaggagtaacataagacataataaccccagtttttttagagaaagttcttcttctttaattatagtatgtttgaaacgtacaagaattcattgagtgccctaaggattactgcaaacaaggttcaacagtgttggtacacatgactcagcaagaataccgttccccctcacaacgcttatccaaggggaggagcatgtcgctacccaaaatatttgctcgtaatttgagatctctgcaaaacaatgcacctcctggcaaaaacatcaatgtcaattgtttgaacgtcaattcttgttcgttgtccgcaagcccaagctcacaaattaatatggcttgtaatggaaacaagcaagatcttcccataccgtttcccctgcatgtagaatgcaacgatagctggtcaagctccaaacttaacaagttcaaatcaatgtttaatcataacagatcaaagagcagtggtactacagatgcgtcaacttcagaaaaaggtacgcataagcgtgaaccccggtcgacgatacatacagagctgttacaaagttccattatcggtgagccaaatgtccatagtactacaagtagcacacttatacccaatgaggcgatatgctccacacctaatgagatctcaggtagctcttctccggacgcggagttatttacctttgacatgcccacagacccgtcatccttccacactcctagctccccaagttatatagcaaaggacagtagaaacctgagtaatggatctttgaatgatattaacgaaaatgaagagctccaaaatttccatagaaaaatcagcgaaaatggcagtgcctcccccctggctaacttgtcattatccaattcaccaattgattccccaaggaaaaatagcgaaaccagaaaggatcaaatacctatgaacataacaccacgtttaaggagggccgcttccgaaccgttcaatacggcaaaggatgggttaatgcgggaagattacattgccttgaaacaacctccaagcttgggagatattgtagaaccgaggagatctcgtcgtttaagaaccaagtcattcggtaacaagttccaagacattactgtcgaacctcaatccttcgaaaaaattagactacttggccaaggtgacgtaggtaaagtgtatttagtgagggaacgcgataccaaccagatattcgccctgaaagttttgaataaacatgagatgatcaagaggaagaaaattaaacgagtactcactgaacaggaaattctcgcgacaagtgatcatccatttattgtgacactgtatcattcctttcaaaccaaagactatttgtatctctgtatggaatactgcatgggaggggaattctttagagccttacaaacaagaaaaagtaaatgcattgcagaagaagatgcgaagttttacgccagtgaagtagtagcagctttggaatatttacacctactgggcttcatatacagagatttgaaacccgaaaacatattactgcatcaatctggtcatgtcatgctttctgactttgatttatccatccaagcaacgggatcaaaaaaacccaccatgaaagactctacgtatttagatacaaaaatttgttcagatggattcagaactaattcctttgttggtactgaagagtatttagctccagaagtaatcagagggaatggccacactgcagcagtagactggtggactttaggaatattgatttacgagatgctatttggctgtactccatttaaaggagataattcaaatgaaacattctctaacattttaaccaaggacgtcaaatttccacatgataaggaagtttcgaagaattgtaaagacctgataaagaaactactaaacaaaaacgaggcaaaaaggcttggttccaaatcaggagctgcagacataaagagacatcccttcttcaaaaaagttcagtggtcgttcttaagaaaccaagacccccctctaatacctgcattaaatgataacggctgcgaacttccttttatattgtcttgcaataaacacccgaaaaggaactcagtgagtgaacaggaaaccaaaatgttctgtgagaaagttgcaaacgatgatgaaattgatgaggctgatccattccatgattttaattctatgagtttaacgaagaaagatcacaatatcttaacctactctgaaaattatactacggaaaaattctatacaaagcaacttgtacaaggccaaggcataacagctcacatagaagtttctttaaagacatcatacctgaactataacatgtttacagaaagataaacccatggccaaatttctgtattgtttctctcaatttatcttatgataaaaatgtaaaaaattatttaaaagtaaacaaataaacaaaggaacaattcaaaaacgagaaagtgaatgaaaaatataatatcatttattgtctgataatgctgcatttagaacatacgtaccatccgcatcagtggatatccaatgatagtaatttcgcgagtttatccgttgctgttatattatcactttttaatattcttttcaaagagctgaataatttcaacgcgtcttcgttaatggattccttccgcaattcttctgaaatactgaatgcccgatttataatatctttgtccaggcgtgccaatttcgccacattcatcccataactattataagtcaatcccttttttaacttatatagaaaaattacactcatccagtcctcgccagttttttgttcttccacgtaatccatatgataattccttattaacggagatttgatttctcccagcatgggaaaatgggtagtaaataatatcaaggggcagtcacttaactcagaaaaatactttattaaagcataagaaattgctataccatcgtgcgtgccagtacctcttcccacttcgtctaataatagtaaagaccgtttattgcaatttttcaagatgtgtaggatatcaagcatttccactttaaaagtagaatcaccgtttataatatcatcgtgcgcaccgattcgagtgagtacgttttcaaatatgcttaatctgatctcttctgcggggacaaatgagccgatctgtgccattatagtaagcagtgccacttgtctaatataagatgatttcccacccatattcggccccgttataatattgattttaccgttttctggggacatcatgatatcatttggtacataatgaacatccagcgactcgataattggatttcttgcattttttgcgattatggcttgttgaccattcacaaaagttggtctaacataatttacgttgcatgatgtggctgctaacgacaaaatacagtcatactgcgccaaattgagtgtaattttacggagctctgtatattctgccgtaattttgttcaagaattctttatactgtagttcagattcccgaattaataagtccttgtaatattctagcttttgagtcagtttctgggttctgggagtggtaaatctactgaccatcttcgtattgttaacttttatccaatcatctggcaagtccttaatttgcgagtttttcacttcgattaagtaatcaacttcatctctaaaatttagatatggacgtttgagatattttcgtatttctgccaattcttcctttaactgtgaccgtactgattcgctttccctttgaatttttattataccctctgaacaatcatagttatttaaattaaaaaaatccattacttgcttatctgaatttttttccattaccgcagaaacgttgatcatggtcaaaaaatgaggcaactgagtggtagaaagtagttcattcaattcactaaatagtctaaaaagtaaaggagattgtttgcctatccttccatctgatgacttgaaatgttctgacaggtaagattgatgcatcttgaagtgatcaacgaaagaagttatttgctttaaatagaaatagacttcttttctagaagttgtaccatacattatgcgatttaaagttcttaataagtcaggggtatgattcaacatttgattcaacgattcaaaaaatatactgttgttgatttcggatgtaatgcactcaatggcatcaagccgctcttcaatttggtgtacatcaaccaaaggtttgagaatccattctctcaacattcttaatccaaacgatgtccttgtatggtccaataaccaaaacaaagaacctttaccaccatcatgggtaaaaatgtccaaactttgcagggagttaggatcaagtaacatatgtatttttgatgcgaagggcgaatagatagaaggaatcaacatcacctgctcattattgtactcaaccatatgcgaatataacttagaaactaagcgtatgagagacggcgagagttgaattttctcattcattacttttattgcctgaactacatgatcttccaaatcatactcctgcttgtgtattaaaggacatgaaatatctttgaaaaatttcgctacatgtaatggaagatcatctgtatttaccagtacttctatgggctgtaaatatttgattcgtatctgtagtttctcatcagcaagattaggctcttcaaattcatcatacacgacttccccgttatttaaattgacagaaattaaggaatatttagccacctttccctgatgtacgtcacgggacaaagcccatatactgtttgtatcaccgagaatacgtttccccctaaggacaaaggtggaattaacaccaaatgtagctttggtaaagacatttgaaatctttctttcaaaaacgcttgatttgctggcacctggatcatgcttcttaatagcgcttgtttctgcttgctctaccacggcaacctttaaattatgatgcacaagtctctctaggtgaacgtttaatctgacatccgggaaagaacagtacgcaaactgcctatgattgcaatcttgaggattagactcatcgatagtcaattttccaggcacaagtttgatgtgaagtattctgctaaccgttactgcatcctctgcaaaacatttgtacttgtagcctactctaataacaagcactttatctctatgatgcattttcaggtccttcacctgtttgtccaagggagtaagtttcgctgtaggggactttctggcttttttttttacgaaatcttcctcaccctcttcctcatcatcttcagcctcaacattttcatcacttcgtcttttcataatcctatccaatttcttagcaaagtcaatatcattaaatgttgtcgaagtaccactagtcttttctgaatttttcgaattcttggaagaaacactgcctttgagtggaaagctatcattagttactgttgtgcttgcaacagaagataaattgtcctcttcatcagtgtcaaggcagatggattcgctaccagcgccatttccaaccgcaacttcttgttcttgcttatgcgtcagctctgattttaccgccttcttgaaaaacctgcttattgtgggttgtcccgccattattgttaatagattcaacaaaataaatctatttgcactgcttttggctctcaaaagtaccagtttaggttcattacctatcaccattgttccagcttatttatcattgaaaattcacgtgatcgcaatattccgtcaggagtgataaatacacgaaaatttttcttttttttcggtggcaaccaaagtcaaaccatcgaattcgaataagataaacaggggcaaaggtgagtcggggaaacactattggtaaaagataagcaattgagaaacgtcactcagggacaattgattacatgctatcggccacataccgtgatttgaacacagcatctaatttagaaacatcaaaggaaaaacaggccgctcaaatcgtcattgcacaaattagtttattattcacgactcttaacaacgacaattttgaatccgtggaaagagaaattagacatattttagacaggtcgtccgtagatatttacataaaagtttgggaacgattattaaccttaagttctcgggatattttacaagcgggaaaatttttacttcaagaaaatctactacacagactactattagaatttgcgaaggatttaccgaagaaaagcacagaccttattgagcttttgaaagaacgaaccttcaataaccaggagtttcaaaaacaaacaggaattacattatcacttttcattgatctatttgataaatctgcaaacaaggacattatagagtcacttgaccgctcctctcagattaacgatttcaagacaattaagatgaatcatacaaattatttaaggaatttttttcttcaaaccacaccagaaacactagagtccaatctacgcgacttattgcattccttggaaggtgaaagtctaaatgacttattagctcttttactgtccgaaatactttcacctgggtctcagaatttacaaaatgatcccacacggagttggttgacacctccgatggttttagacgcaacgaaccgtgggaacgttatagcaagatctataagttctctgcaagccaaccagataaattggaatcgtgtgtttaatttaatgtcaacaaagtatttcttgagcgcaccattgatgcctactacagcatctttgagttgcttatttgcagcattgcacgatggtccagttattgatgaatttttcagttgcgactggaaagttattttcaaactagatttggccattcaacttcataagtggtcggtacagaatggttgctttgacttattaaatgcagaaggtaccaggaaagtttctgaaaccatcccaaacacaaagcaatctttactctacttattatccattgcatcattgaatttagaattgttcctacaaagggaggaattgtctgatggtcctatgctagcttattttcaagagtgcttctttgaagatttcaactacgcccctgaatatcttattttagcattagtcaaagaaatgaagcggttcgttttattgatagaaaacaggacagtcatagacgaaatacttattaccttattgattcaagtgcataataaatcaccgtcatcgttcaaggacgttatttctacaataaccgatgattctaaaatcgtagatgcagcaaaaatcataatcaactcggatgacgcacctattgccaactttttaaaatcgttgttagatacgggaagattagatacggtcattaataaacttcctttcaatgaagcttttaaaattttgccatgcgcaagacaaattggttgggaggggttcgatactttcttaaaaacaaaagtttctccatctaatgtcgatgtagtgctggaatcactagaggttcaaacgaaaatgactgatacaaacactccatttaggtcattaaagacatttgacttattcgcttttcattcattaattgaagtactgaacaaatgcccactagatgttctccaattacaaaggtttgaatccttggaattttccttattaattgcatttcctagattgatcaattttggttttggacacgatgaagctattttagccaatggtgacatcgcagggattaataatgatattgaaaaggagatgcagaactatttacagaaaatgtatagtggtgagttagccattaaagatgtaatcgaacttctgagaaggttaagagatagcgacttgccaagggaccaggaagtcttcacatgtattacccatgccgttatagcagaatcgacattcttccaagattatccattggatgcattggctactacatctgttctttttggatccatgattctctttcaactgttacgtggattcgtattagacgtcgcatttaggataatcatgaggtttgccaaggagcctccagagtccaagatgtttaagtttgctgtacaagctatttatgcatttaggatacgtttggccgaatatccacagtattgtaaggacctcttgagagatgttccggctttgaagtctcaggctcaagtttaccaatctatcgtcgaagctgctaccctagcaaatgctccaaaggaaaggtcaagacccgtccaggaaatgatcccattaaaattttttgctgtagatgaagtttcatgtcagatcaatcaagaaggtgctcctaaagatgtcgtagaaaaagttctttttgttctcaacaacgttactctggctaacttgaataataaggttgatgaattgaaaaaaagtttgacaccaaattatttttcttggttttccacatatttagttacgcaaagggctaaaacagaacctaactatcatgatctttatagcaaggttatagttgctatggggtcagggttgctacatcagttcatggtcaacgttactttgagacaattatttgtcctactatctacaaaagacgagcaagccatcgataaaaagcacctaaagaatttggcttcatggttaggatgtatcacattagctttgaataaaccaattaaacacaagaatatcgcattcagggaaatgttaatcgaagcttataaggaaaatagacttgaaatagttgtgccttttgtaacaaagattttacaaagggcttctgaatcaaaaattttcaagcctccaaatccctggactgttggcatattaaagctgttgattgagttgaacgaaaaagcaaactggaaattaagtttgactttcgaagttgaggttttattaaaatcttttaatttgaccaccaaatctctcaagccctcgaatttcatcaatactccggaagttatagaaactttatccggtgctttgggatcaatcactctggagcaacaacaaacagagcaacaaaggcaaattatactaatgcaacaacaccagcaacagatgctaatatatcaacagagacaacaacaacaacaacaaaggcaacaacaacaacaacatcatattagtgcaaatacaatcgcagaccaacaagcggcatttggcggcgagggttcaatttcacacgacaatccttttaacaacttacttggttctactatttttgtaacccaccctgacttgaagagggtatttcaaatggctttagccaagtcagttcgcgaaattttgttggaagtagtcgaaaagtcatcaggaattgctgttgttacgacgacaaaaataatacttaaagactttgccactgaagttgatgagtctaagttgaagacggctgcaatcattatggtaaggcatttggcacaaagtttagctcgagctacttcaattgaaccattgaaagaaggcatacgttctactatgcaatcactagcaccgaatttaatgtctctttcttcttcacctgcagaggagcttgacacggcaataaatgaaaatattggcattgctctagttttgattgagaaagcatctatggacaagtctactcaagatttagcagaccaattgatgcaagcgattgctattcgtcgttatcacaaggaaagaagggcagaccaaccatttattacgcaaaataccaatccatattcactgtctttaccagaacctcttggtttgaaaaacactggtgttactcctcaacaattcagggtatacgaagaatttggtaagaatattccaaacttggatgttattccgtttgcaggattgcccgctcacgctccaccgatgactcaaaatgtgggttcaactcagcctcagcaacaacaagcgcaaatgcctacccaaatcctaacctccgaacaaataagagctcaacaacaacagcagcaattacagaaaagccgtttgaatcagccatcccagtcggctcaacctccaggagtgaatgtcccaaatcctcaaggtgggattgctgcagttcaatcagatttggaacagaatcaacgtgttctcgttcacctcatggacattttagtttctcaaattaaagaaaatgctacgaagaataacttagctgaattaggcgatcaaaaccaaattaaaaccatcatttttcaaattttgacattcattgcaaaaagcgcacaaaaggatcaattagctttaaaggtatcccaagctgtcgttaatagcctttttgccactagtgagagtcctctctgcagagaagttttgtccctacttttggaaaagttatgttctttatccctcgttgctagaaaagacgttgtctggtggttagtttatgccttggacagtaggaaattcaatgttcccgttatcagatcccttctagaagttaatttaattgatgctacagaattagataacgttttagttactgcaatgaaaaataaaatggagaactcaactgaatttgctatgaaattaattcagaatactgtcttgtctgatgatccaattttgatgagaatggacttcattaaaaccttagaacacttggcctcttcggaagatgaaaatgtaaagaaattcatcaaagagttcgaagatactaagataatgccagtgaggaaaggtaccaaaaccacaagaacagaaaagctttacttagtatttacggaatgggtaaaattacttcaaagagttgagaataacgacgtaatcacaactgtttttatcaagcaattagtcgaaaagggtgttatcagcgatactgataatttacttacatttgtcaaaagttctcttgagctatcagtttcttcattcaaagaaagtgacccgactgatgaggttttcatcgctattgatgctctaggatcgctaattataaaattgttgattttacagggtttcaaagatgatacaagaagagattacataaatgcaatattttctgtgatcgttttagtgtttgctaaggatcatagccaagagggtaccacattcaatgaacgaccatatttcagactattttctaacatcttatacgaatgggctaccatcaggacgcacaattttgttagaatatctgattccagcactaggcaggagctgatcgaatttgattctgtattttacaacactttctcaggatatttgcacgctctgcaaccatttgccttccctggattctcatttgcatgggtgacactattatcacacagaatgttattaccaattatgctaagattacccaataaaataggttgggaaaagttaatgcttttgattatcgatttgtttaaatttttggaccaatacacaagtaaacatgcagtctctgacgctgtttcggttgtttataagggaacactgcgtgttattttaggcatttcgaatgatatgccatcctttttgattgaaaatcactatgaattaatgaacaatctacctccaacatatttccaactaaagaatgttattttatctgctattcctaagaatatgaccgttcccaacccatatgacgtggatcttaatatggaggatattccagcatgtaaagaactacctgaagtcttctttgatcctgtaattgatttacactcattgaaaaagccagttgacaactacctacgtattccctcaaattcattattaagaacaatactaagcgctatttacaaggatacctatgacataaaaaagggcgtaggctacgactttttatctgttgatagtaaattaattcgcgctattgtattacatgtgggcattgaagctggaatagagtataagagaacttcttcaaatgcggtatttaatacgaagtcttcttattatactttattgttcaatctgattcaaaatggtagcatcgaaatgaaatatcaaattattctgtctattgtggaacaattgcggtatccaaacatccacacctattggttcagctttgtgttaatgaatatgttcaaaagtgacgaatggaatgatcaaaaacttgaagtccaagaaattattttaagaaactttttaaaaagaattattgttaacaaaccacatacctggggtgtttcagttttctttactcagttgataaacaataacgatattaatcttttagacctgccctttgtacaaagtgttcccgaaattaaactaattttacaacaattagtaaaatattccaaaaaatacacaaccagtgaacaagatgaccaatccgccaccatcaatagaaggcaaacccctctacaatccaacgcataaaaaaactgcatttatttatatacgaaaatcatgatttcagaaaaaaaaatataacttgtataatactatatttcagagaatactattttgaataagaatagaagcaatttcgattaacttttcttactgtatatgggtcgctttcacttttgaactactgaaaattagtgttacccgtattattgttttggagaataataataataatgagcatcaatttatatcaaacaagagctgcaattaccttatgtccatgacgcactgcgaacaaagaataattgagtaatcgaacttgaagttctatagaacagcttgtatatggtttcattgttcaaaagaggtaaggctccaccgctcacgaaagaaggccccacttctaaaaagcctcctaacacagcgtttagacaacaaaggcttaaggcatggcaaccaatactgtctcctcaaagtgtgcttccgttgttaatattcgttgcatgtatatttactcctattggtattggactcattgtaagcgctactaaggtacaagatctaacaattgattatagtcattgtgatacaaaagcatctacaactgcttttgaagatataccaaagaagtacattaaatatcactttaaaagtaaagttgaaaataaaccacaatggaggctaaccgaaaatgaaaatggcgaacaatcatgcgaactgcagttcgaaatcccaaacgatatcaagaaatccatttttatatattataaaataaccaatttttatcaaaatcatcgcagatatgtccaatcgtttgacacaaagcaaatattaggggagcctatcaaaaaagatgatctggatacaagctgtagtccaataagaagtagggaagacaaaataatatatccctgtgggttgatcgctaattccatgtttaatgatacattttctcaggtgttgagtggtatagatgacacagaagactataatttaactaacaagcatatatcatggagtattgatcgtcacagatttaaaaccaccaagtataatgctagcgatattgttccaccgccaaactggatgaagaagtatcccgatgggtatacagatgaaaatcttcctgatatccatacttgggaagagttccaggtatggatgaggactgcagcctttcccaagttttacaagttgacgttgaaaaatgaatctgcttctttaccgaagggtaaatatcaaatgaacattgagttgaattatccgatttcactctttggtggcacaaaatcatttgtactgactacaaatggagctattggtggtagaaatatgtcactaggcgtactgtacctcatcgttgcagggctttgcgccttatttggcatcatttttttggttaaattaatcttccaaccaagagcgatgggtgatcacacttatttgaattttgatgatgaagaaaacgaggattatgaggatgtacacgcagagaatacaacattgagggaaattttatagaggccaaaaaacaaactttagtgcctgtaggtatttgtgtttataagtaaacaagttttgttgacttcctgaaacgtaaacaaaagaaaaattgaagtatgcctttttacgcttggaaaatagtgcgacaaagaactcccagggtttgctattcccatttagatgatgaaatgatagaaaagtggaaaacgtttatcatgaaatcatctatacatatacgtaaaaatgtaaactatgtaaaaatatgttccctataaaagtgatgctcttccggaacgttttctttttcccacaaatctcgttgaaacctgaaccaatctggtaattcagaatcacagggtatccttattttgacgttatcttttccccttgctttataatagccataatctccattttcttttttattaaatgctaatctatacctatggccaaaaattcctaggtcagaagaggttttcttcaaatcgtctcctagaactccacttacttgtaatactttattatttttcactttggtttcgatttgatttattaatgtcaaaagccgctgaggcacttctggctctctgcaaaggtcatcttcatttactctaataagtttgccagaattggccttatactctatcgaatgcgtcctattattctcaaggggcaatttttttgctttgttgtccacaattgtcttattatccttctcctgttctatctcaatgttaattatttctagaaatgtttccgcaaaataatttctattcttaccagaaaataatctgtactcatttatgattgatgcaatattccatttctgaatttttcgaagtataccaatgaccaacgcggtcttatctaccaataaaacattataattatccacattcaataatgttttgaaagttctttttaaacacgtgctcttaatcagcattaagtcatcattgtcagtcaagtggtaagccaattcctcctgaattacaggatcccctgtagtagaattttgtgacccatttgcagtggattttttcttttcttcctgtaatgatagagtactgttattattcgaatataaatttgcgttagatacagaagagctttttaccggaactgccgcagccgagaaatcagacatccttaaaacaatccattttatggatgatcttgtgaaaaaatctttgaaaaacttggatggttcttgacctccaataaatatagctgtctttaaattgagagtttccagaaaggataaatttaatgtctccactttagaacatctatatattccttcttcagcaatcccaaagttagcaggtggaaccagcattatgaattcaggttatggatcgcaccagtgctgtaagtgtctctctttttattctacgatctccatataacaaccacatctcatttctttaccttactgtccatttaatgctagaaaacttccgaatattgtattattattacccggatatgtcaaggcggtatattaagatgttcctttcaaaagtttcattataccgcatacggtaaggacagccataagtagttttactgataaaatatggggctaaagaactgtatatttatggatagcactaaaagtaaagattttccccgtgtcctgacttggagaaacaaaatttcattgtcataaaaaacttttaaaatatgatattcaaagcttgagcattgggcttctggatgacagttctaatcaagttgggtctaaggatattgcatgtatacaaaggattctttcggaaagtaatcctgaaatatttttttttttcgtctgaacatacgaaagtaaataaaaaaagttcaatgcatgccttcctatgcaagatttataaaaggtgaacaggtcaggagcagccacatctcaataaaggcagttaaagacggtgatgtaggtgcagaaagagaaagtgaacaaaggatgatttgagatgtgtaatgattcgtttgagcagcaacaactgctaagatattcatactaataggccacttcacacattatgccttggagaatatcctgcattgctccttttatagtatagtctattcagcactaacaagcaaagcgaacataatggtaaaactaacttcaactgttgctggtgtcgcctgcatcgctggccctcccctccactacggccattttagcacaacttgaatgagtcaacttggttgagttgcatgttaacgtctctgatatcagagctcacttgctcaataatacatgttacaaactgcccactaaattgaacactctaacattatattgacctgaattatttgaaacgaagtcaacagaatgatcactgattttccaatgtactccgctatgttgaagctagccatcttaagcgatcaatgacggtgctcaatcattcttcgaaatgggctaaaaatgacagttgaaatatattctttacgttcattttttttcatactgcaaacccattctagaaccaatggtaaaagtgacgggagttgctttcttttactatttcaatgatagctatagcctgcatacacacaaaagaatgtaagtgattgcgtgaaagcttaaagtcttaaaactgtatttttttcaactcctcccatatattaaactggtcctcacagttcgcaggataactaacaattaaaaaaattgttcatatggttgtatttctttccgtctcacattattaaaattcaacgaagaagtttctacaataacagacaagggcctacgattactatgtactggaaggtgagtcttgaattcatcctcagagattgttctaaagaccaacagaaatccatatagattaccgtagttactctgatggaatttcagagtaagacccttgtcaacttcatcactttaagttgagatgtagaaagacacttttgtaaggtctccaacaagtatatttgataaatagactgttgagctacaaaaactcaatgtgaagtaaaagacctcataaatgatcgattatctgtttggcaggtactaataaaactgcattggtgtcttttttcacttacgttaaaaaaaactttttgcaatgatttaagcgtgcgtgaagataacactacaatccattttaaagcaacatccacattgagtgtatacaccacaaaggttttttcagggcgtttttctcgccactttatgttgaccaaaattattaatggaacttacaacgtttccaaaagttagttaaatacatacgtctatttactaagcaagaaatatatcatgacaagcccaaatattatattgttatgtttacaaaaaaaaaatggctatatacatcaagtctggaggctttttataacaagcaagtggggtaacttagacataagattgacttctttgaattcaacaaaaatacatacttttgatgatttcaatggtagaagcagtagtaactatgccgatgaaataaaatcctgatatcatctatatagtagtactcacgttactagtatatcatctataagatgtaggaaaatgtcataagaaatgagaaacagtcattaaatttaatggaaacgaaatgcaaggattggtgatgagataagataatgaaacatagaaaacgaaaggagaaataacagtagtattattattattattattatgtagaaatattgactctctcttgtagattcatatatcttcaaggggaacttcttgtacattttgtatacctatattatagcgtttaacaacaatggaatcccaacaattaccaaaattttcacacattcctcatataaaatctaagcaatgactagagaactatcgctaaattatatagagcaaggaaaccgaataattacatgtgtcagataagaaaaaaataaagaaaacaacgcgtcatgaaaaagagttactgaaccttcagatcctacttattgtaatgcttcgcgacatccaatccatttaataatcaatttaaaactagagttggtagagttccttgttgaacgtgataacccaaaagcataatacgagtaatgtttcagtattgctattatatgtttacacaaggaaaacatataataacaaacctctaatccggtagtacttaagaaactatagtttctatgtacaaaaaggtaactatgtaattcttacatttacataacatatagaagggtccaataaacttactaaacttactaccttgttgtatataggctagatcgtaatccactacgtcaacataaaaaaaacttaaggagtttgaattttatgtacaaacagattgttaaaatataatataagattatggaaacgaacttgctctaaaaaaaatttaaagttttataaaatcctcgcactatcgctgttatacatgatgtccccaaagcgtgtacaaataattttgtagtattgtatcggtaatatcatacaagaagaaaatagttgcaaatctctaacccactagtacttaaaaaaactgtagtttcagtgcaaaaaagttttaacattacgtatcttgtaccctttttattgcatatagaaaggtcaaataatccttcacatcatgaaatataagctaaatcgcatttcttttcgtccacatttgcaaacaaaacttttcaataataattttataaatagtatcaatatatatatatatatatatatttatttgtttactttttctatcagtgttttcaattttttattaaacaatgtttgattttttaaatcgcaatttaatacctaaatataaaaaatgttattatattgcaaaaacccatcaaccttgaaaaaaagtagaaacgttttatttaattctatcaatacatcataaaatacgaacgatccccgtccaagttatgagcttaatcttccataaaaatatttgaaagcaatagatcatgtactaaactaaaatcagggaaattaagactccttttgaagtaatacctattacttactaatacgtttgagaataagcgcaggtactcctggtttttgttaaaactacaaatttatacttagcattacgaagattctcgattccgaaaaacaaaaattttatcgtcatatacaaatctagaaattaccagagctatccatcttgttcaagaaggtaggcgaggacattatctatcagtacaaacatcttagtagtgtctgaggagagggttgattgtttatgtatttttgcgaaatatatatatatatatattctacacagatatatacatatttgtttttcgggctcattctttcttctttgccagaggctcaccgctcaagaggtccgctaattctggagcgattgttattgttttttcttttcttcttctattcgaaacccagtttttgatttgaatgcgagataaactggtattcttcattagattctctaggcccttggtatctagatatgggttctcgatgttctttgcaaaccaactttctagtattcggacattttcttttgtaaaccggtgtcctctgtaaggtttagtacttttgtttatcatatcttgagttaccacattaaataccaacccatccgccgatttatttttctgtgtaagttgataattacttctatcgttttctatgctgcgcatttctttgagtaatacagtaatggtagtagtgagttgagatgttgtttgcaacaacttcttctcctcatcactaatcttacggtttttgttggccctagataagaatcctaatatatcccttaattcaacttcttcttctgttgttacactctctggtaacttaggtaaattacagcaaatagaaaagagctttttattcttgatttttgttctttcggggaaactgtataaaacttccaaaaaggaaaagtaaaacaatacatctccttatatcaaagaaaatcaagaaggacaacatggatgatatttgtagtatggcggaaaacataaacagaactctgtttaacattctaggtactgagattgatgaaatcaatctcaatactaataatctttataatgtatgttttcatttcaaggatagcctttgaatcaatttactaacaatacttcagtttataatggaaagtaatttgactaaagtagagcaacatacattacacaaaaatatttctaacaataggttagaaatataccaccacattaaaaaagagaagagcccaaagggaaaatcatcaatatcaccccaagcacgggcatttttagaacaggtttttagaagaaagcaaagccttaattccaaggaaaaagaagaagttgcaaagaaatgtggcattactccacttcaagtaagagtttgggtatgtaatatgagaatcaaacttaaatatatcctatactaacaatttgtagttcataaataaacgtatgagatctaaataaattcgttttcaatgattaaaatagcatagtcgggtttttcttttagtttcagctttccgcaacagtaaaattttataaaccctggttttggttttgtagagtggttgacgaataattatgctgaagtacgtggtgacggatattgggaagatgtgtttgtacatttggccttatagagtgtggtcgtggcggaggttgtttatctttcgagtactgaatgttgtcagtatagctatcctatttgaaactccccatcgtcttgctcttgttctcaatgtttgtttatatactcatatttctatgtgtttatacaattgctattgtttatataatgtagtgacattttctcttaatcttatactaatttctatgacatttatataagaagagacttatgatcaacataattttgcaaactttgagagaaatatgtctttctactgcgataaagttattatttagattacatgtcaccaacattttcgtatatggcgatataatttatcatgttttggtatgataatttaatttttaaaaaaacaaatttaattgacctcattaattaatatttattaatacctttaaatgttgaggtaaatagctattttctctcttcttttcctttagttggaatttgcacaagaaaatgtttttccacacactttagcgttttttcctaaatgttggaataaaaaacaactatcatctatcaactagtagtcacactaccaatgtgttatcattatactgtgttaaacaatgacataaggtatgaaaatttgtcaacgaagttagagaaagctggatgcaaggattgataatgtggtaggaaaatgaaacatataacggaatgaggaataatcgtaatatcagtatatagaaatatagattcccttttgaggattcctatatcctcgaggagaacttctagtatattctatatacctaatattattacttttatctacaatgcaaccccacaataatataaaaattcaccaattccgcatctgcagattactttcctaaatttgcatatagaattgtcaagcgcaaatccgacgtcgattccgcggcggatgggtcattctaggtcattctaccaattttatttgagaccaggtttattcaaccggtaacatagaaatattcatacaattaagcttctatggccaagttggtaaggcgccacactagtaatgtggagatcatcggttcaaatccgattggaagcattttttatcacgttattcggtgacacccaggttgccgccgcgttcgcgtccatcgtcatctgaaaaataatgaatattaatggaccttgtgccccataaaggttccatgttccataagtcttcaataatacttttgtatattaaatttaccgttattcggagatctcttacggcttatgattttctttacattccaggccgccttttgatgacattcagtgcgtcacgacgcgaatagggctttgaaagccttaatgtggagtaaataaatatatgaatgcaataagtaaacataagacgagttcttctatatccggtgtacctaataatatagattttgccaacaatggaatctcattacccatcccaagataaaatattgatcaaggcatgggccaccaacataggaatacgcaaaataggattgatatttttacatattatattatctttcttcttctgtctcaaatatagctcttctcctatttaaaaaattatcaattcttgaatctcaacttccattaaatttgatgattgtttcccaatatcgatgtcatctttttacactgtaaattataatttactaggaacatgaatactgatcaatggatgatagttgattcttattgcaataaaaagtactttctaagacgctaggacttctaaacacagatattatgaaaatgccaaaaaatacagaatattttccttcttttcactataacaagtagtaagaaattaagcaatatggtaatttgagcttatcagataaaagatcctggtagtcttgcaaaggtgtgagtacttttgatgaaactaagtttcagcgcagctatttcaattttggaacctttaaagaaagtttaatcgaaacattgaacgatccaaagcacaactttgtagcgggaagtcacaaacaaatataaaaagtgttaataaactgccatcctatgttagaattgtgaaactttttggactaataaaaggttttcaacatggtgttccaaagcacttatttctaggttagctatggtaacgagttttaacgtaatcaaaacaatatacaattcaagatctgtatcatttacactaacacaccccattttaatagagctgagtacttcctacatttcttttgcatatgatatcgccactgcatcatttctgtagtcgtaaaatttccttctcattaagacaccgaaaatagctaaggattataacaaaacaaacaaatgctcaaacaaaacttttagtaaatcttttgaaatgtaaaagttacttagaataactaaaaaaaaaatattacgctataccatatatttccattcccaattttatcgttttataataatattcagtttcaagaacaatgaatatatttcaaacattacatgcactcttgggagtaagctgcatcataataaattaaaattaacgctttagaaaaagaaattttgaggttaaaggatggaggaagaaatcgataccaatttcaactttgatcgacctgtctgactgaaattatttctgcgtttttcttactacaattagtaccattctcttcaacttcaatagttctaaccattgattcttcatctgtctcatcaaatcccatcttaccagtccagccattggataccaaatagttgtgaaattcaacgtcttgcttcattaaatcgctttcaagagaatgtggaacaaagaaatatgtaataatgataccaataagaccacaaattgcagcaataataaaagtccatcttgcacccaaattatccctaatgggttggaaacattcgacgcctactacagaaccgattttaccagtcacagcagataaaccatagaaaacacctctaacagcggttgctgacgcttcactactaataacaccaagcatatcacctggtccagcattacctaacatattcatgaatgcgtagaagataataaacaagggggtgatttttttcaattggtcgtacgcacatccaatgattagaccaaagatgatgtacccagagaaaccaaacatcaacgtatatttacgaccaatacgatcggacagataagcaccaattggtacacccagtacagctaaaactcccaacagtaagttccactctgccacttttactaaatcattttggtccttgataacggaactgataattgttgaactgaaaataccatttgggaaggtaacaaaatcatacataaaccatgtaccacatgtaccaagtaaccttttccaataaaatttcaatgctaggaaatatggtatatttctcttgattctacctttttcatagacttctgtagtagcagtcttccatctaaaatagaacacactcaatggccagaagcaccctattgcaaaaacagtcctccagatcgcctctaaatgttttgttcctgaacagattttgtagacgattaaaaagatgatcgtagcaaatggaccaccgaaggctagtggcaaatttgtcaccataaccaggataccacctcttttggtagtggtatattcattagcagactcattagcacttaatgtactggtaggatattctgcaccaacaccaatacctaccaaacctctcataactgttaacatccaaaacatgccaggtacagtagtaccgtgagaggcagcacacagagcactaccaataaccaagatagcagtggccacaaggatacaagattttctactataataatcagcagcgatacccataaagaattggccaaaaataataccaactagggctgcgttggaaactctagtcgacacttttgagctatagtttttcttaccgtactccataacaaaaaccttgtttagcatactcattgaaccatttacgtaaccatcacttatcagagcaaaaccggacgcaatgattgtaactatgtttttccatttatctttctttgaggtttcagtacgggttgcacgcctctcggcatcatattttattattctaggattagtgttctcgttcacttccttctcatttaccgatgtgatatctttgtcttccattttttatcctattctatttttttgattataagcaaaaagatcaactcacgtctgcggctggttgactagtcacaagaaacagataataaatactgtaacgaacatctgctacaactacattcatcggggtttatatattcacgagtttcctacttcatccagacacattctggatgtcttccagcagatgtccctcatcaaagaattaagatagccagattgaaaaactaggttaaccagagaactaagttaactaatgttggaaaataatcctacgatacagtggacggaatgcccatatgcctatataatcaatccatgctaaggtgggggtccagtaaggaaattcatgaatatgaagataaatgtggcaccaaacggcaacgcggaagaccgtaggatccaatcatataacccctattattctaacatcattgctgttgggtacaacattctacgccgctattactacgtgctgcttcttttgattctctgctttctttaccgtcatgcacgtgcgccgcgaaaagtattaatcatgcggacactctggcatttaggggatactgtcaaaaagactatgctcaatactgtcatattcatatgcacgttctttttttaatttatcttggcaaaacgtggggctggaacttttgaaacgcactgcaacatctgtggctgtacagtcaagaaaagtaagtactcatcgtcatgctctaatgtgtatatggtatttgtggtgcagacaccattagaagtatagttcacgaaatgatgacacgatagcatgtgcttttcgacggctgataaccttgtattctcttatttttgtattcttttcgtaagcggcatttgtttgcagaaccttatcgcagatatcgataaacatttgttgacaattctttttcgctccccttctttttgtttatcttcgttatattcaatagtctacatacactaaccgttgaattgttgcaaacaaatactaataaaaatctatatatagtaaattgaagatgtactgatcagtctatcattgtttagtgcacccagactcgaatcttaaataccactttacacacctactaaattttgtcctcacaaaatgaagacaggattcaaaaccgattaatagtagcagaaactaaaaaagtacgaatattagtaaaattcatgttcttgaatcgagctactatctttgtcgggagggtaaacgattataactcaaaatgactggaactggtgattattaatttttacgtttcctgtgccaataagcggaagataagaggatagaagaaaagaaaggcggcacttggcgaactacaatggcgattatattcatggcgattatattcatacaaaggtaatggaggcctcggataatggacaatattgagaaaatccttatgcttacttctcttaataaaaaatagacacagccatttattatgcgtaaaaaagattacccacttgtcttcgatgcgtgctgctgccaatcaaccttttgagcggaacttcgagctcgcaatgcgtctggaatgttgctagagacagtcttggttatctgtgacatgtgtttcgttcaggcgtgtgagcatcttcttgttcgatttcaaaattaccgccttgactcgtgaaactggataattcgttggcgttttcatataagtcgtctgatggcgaaaacttttcctttacttagcatacagcaaatatccccatttgacggatttttgaaaaatgagcccgctaacccagaatgaactgcattaccaagcatttatgtaaacgttccgccaccatctttggtaaggtatactattatgttctggatttaaggttgattcacaatttttcatcaccaaaatctggtggcatgcctagttgtctggtttcaggcaatttagccatcatagaaaagcatcctctgtcttgagttgagaaaatgttactcatagagccaaacaaataaaccctggaattaaaatatagtttaaacacaacttcatattacactgtaaatacatatcacaataataaattaacgaaatagtaagaccttatgtttctatatgacatcagtcccgaatagtgtcaattttttgtcgtcagtgtcgaacatttttactgtttattcatcatatcgtgaggtatgtaggcatcttctattgacttaagcatgataaaagattcacccaaaactgtatcgaaatattgataaaattaaatttcaaagtcaaacttgttttcaatggttgctattttcttaccattcgagctctccctcaggattttttcacatggaatgttcatggcctcaatttccatgggctttttgcatttatctcctttaattaattgtaatggctctaatgatacagtttcgccattagctttgtcacatatatcggaaagggcaatctgatcataatctggtatacagtcaccctttgcatctctaacaaattcagaagagcattcgtagtcggattcagtacaactgtcacaaggtatttcatgcaaaatcatatctttgaatgtcctttttaccaaacaacgggcgtcctgtttcctccttttatacatgtatttggcgccattaaggcatttcccatctgccaaattccagtcttcgaaatcttcctcttcacacgttttatagtcaaaatgcagcagaaaaatcgatcgcatacaggacacttcttgcaatatatgagatgttggtgttgtttccttcttgactagccgtagtaatgagatgtccgcttaaaataaattttgagcctgatccatctggcgttgtattaatcaactctaatggatggatataaaataaagcgtcaacaagctcatattgattccatgttctaccttggtccaaggaaaaataaagtttggattgtacatcaccatctttatatgaaggagacgggatatatacaataatatttcccagatcaccagtagcatataatccagaagaattatgggccaccctccatgttagaccaccgtctctagaaatgaaagtttttcggtccttccgatcgaattcattgtcatcgccaacagaacctgtcattaatatgatcccagcagaaggatttgaaagttttagattgtaaaaataaccctgaagtgaacatctctcaggcctagtgatatcacagccgaacgaatcggcattttcttcatcaacaactttcaaatttgaccatgtgaggccgttatcaacggatattttggtttctcctccggctatattttcagtatagtttacttggtgattagaatagtcaatggaaggatgaaacgatccaaatattgtccctttcaagaaatcaggaaaagtgagcctaaaatttccaaactgatggtttggtgtccattcaacaggtgagaatttcaacccttgcgaatctgatatgaaaatctctgagagatctggatcagcattttcctcatttgtgatttctgtcgatataagaaggatgatccttccgatagaatcttcacgaattttaatcactttgacgtgccgtaattgagtaggcagctgtgccttttgaaaagtagatgcatcattggatatccagatgtccgtagatgacatctcgttatgcccgtcatcttgcgttaaaacgaccacatatgacttcaatatcttgtattgagtaacaatcttatctttaaattcatcaaaatctttaaacgttttgcctccatcactactgaaagccaactgtgtgtaggtagcagttaagcgatattcttcatcgtattcacggttagagaacaaacagagtatcgaagtatcattaccagtaaagtcagaatccttgctagacttaatgaaatgacagctttaagttgttatatcgtcgtcttttttcttttccaaggaaggtttaattttaaaaaaggattcccatcattgctcaagtaaatttcacttgggtcatataaaacgtctgcgtctatcatatagctatagcaattcgcaataagaagttctttgtttctaggatgagtagttataaaacagtcgccatctaaatattcttctgatgagggtatagttaaagccctccatgactccccacggtcgtcggtaatgtagaatttgggtgattcacatataaaagcgaaacctctttcctgtccatggaaaggatcaacagtaaatctgaaaatgcgctcttcaatttctttgaccgtttcccaattttctccagcgtcgaaacttatccatacaaccccccaaccatctaatctgatagaagtgttggaatcatcaaaactcactagattaaatgatgtttctataggagcctccgttacttttgggacaaatttctctgcattgagtagcggaagtagtataattacccaaagagtatatatggcatgaagtaatatcataattgaggatctcttaccttttcttagttcaaagttttttttcaaagctcggaactttatgctacaattcaatgactaaaaaaaaggtagcggataatcttttggttgcaaattggcggcatttaaatatattttgggttgcaagtattctaaaaatattctcataatattctaaaaatatccagtctaggtaattgcaattattttgagtccggtgactttgagttgaccatgttcacttcctgtacagccatcaaggtaacgtgtttaccatctaatggagaaaaccaagagataagactagaaacctagttaggatacttggatttgctaatgtcgccagtagtacgataataccataaagatacgctgttgaacctgatttgtatatttaaagaatgggaatctttaagggatcatagtctagaatggtattctgcagaatagattttaaatggtgaaaactttccctcactatgtccaattgatgctttttaggatgacgttagaattttattctggtgaaggcacttttaatatgaagattcgttgaagtatcaataaccttttattggcatacccttacctaactggtctctctcacctcgtgatgttacgaacgccacgattattctcaaactaggtaaagattttttcttcaaaattagtgggaaagactcgacagacccgcttaccaggtattctttctaaacaatagggtttaccagtacccctgaaaatgataatgcccatgtgcggctgatcgcgttaactacgtatgcagttgaatcaaagccataccacagaaaatggtacaagagcccactggatagaatagtgctggctatcaaaccaatattttctttccagctcttgggggacctctactgcgttatatcgtagtttccattcagcctgcttatcgccttaggaaaagggaatgtaagaggcagaaaagtgcggcgcaatcgttcggacagcgagccgctattataggtaagaattcttaaagagcttcgccggatattattacagtgtattaaatttcgccaagtctttgccaatggaaataggtgcataattttatgtgcttggtacatatgagttcaatagatatgtagtagttggatagtagatagtaaggatatataatcatggaagggtgacgcacaacaaatcacataatgagttatgattttcactgttctcatctgtttcccctacaaggcgtgatcaataacaaacaatttcattaaaaaaaaaaaaaccaagtcactctaacatacgtaataactgtgtatacaaaagaaaaataatatctgttcgtcatctagtttaatacggcaactagtttttcaccagagttcttaccgattttaatgtcttccaggatacgaggaacatcgtaaagcccgttcttatagacccttgctggaatatggtgaatttgcccatcactaatctttggattgatgaacttgacgaattcggtggcagctctcctggcttctgggtcagcagggaaagtaatgccaccaaatggtacttcatggccgcctattgaatacagtcttgttctgtcaatagtgacattttgcctcctattctcctttttgacgttttcttctgtcaaattagttaattcgacaacggtagcatcctgtttatcggccgcacatttgtacacttgttgaagcgtattttgattcgcgacacagtcgactaaatacgagatattgttgtacttgtgtttaatttgttctaccacgtcaatatcatggtaatcaaatagttgatcagcaccatattctttcaacagtttttcgtgtttccgagaagccacaacaatgatcttggtgaagccattcaatttattggctaattggatgagcgactgacctactgcagttgcaccgccccataataagatggggccgtttctttgtggggttgatggctcccacttcaggttcaagcccaagttataggtcaacaccaagccagctgtggtcagtgacactgggatagtggctgccccttccaaagacctgacagggccggcaggtagaacatcttcacccaaaaatttgagttcattgggtgatttgtaggcaaccacagttgaaatagcagaatattcagcaaaagcaccattggaaggaaaccttacggaagatccgtgaatgaacccataaatataatcaccaatagaaaagtctttaggatcgacggctgggcccaatttgacaatttggccggcagcgtcacatcccagaatagatccttgaggcccgaccttgtagtcaatgtgtgcccaatcagtcgggttaccagcaacagcgagtgtcttaatcaatacgaatccttcttccaattcaggaatgggaacgccctctttgacaaccgctttaccgtcttcaatgacgacagccttcatggtttctggaattgcaacttgcctgtttgtaggttatatgtaattgtcgttgataatctgtattcagcttgccattttatagaatatggttagaaggatcttaagctagataaagaaaaagaaaaaaatagaaaaaagcctgcccgctttataagaacttttctcaatatctgttgaggaacacttagtaatattgtctatcatggttgctttattcttggtgatattactctctgggattcgatgtgttctcatcatctgaagggtttcctatgtgttgaaagcctatcccactagacggagccgcgcgccagccgggcggatccgagacatcttagtcagctgagacaagaaggcacagctctcggacaggaactgctgtcatatgaaaacctaaaaatgtttcctggaaattccatgactgcgcaaagtttgatacgtttattgttcttctctactaccgcactttctatctcggaaacctttcaactgaatgaactattgttaattgtatggcgtgtggccttgctatttcagcaaatttagagtaagtaaactccgtcggaccagtatagtaacgaaacaagccattgattctgcagcatattgcgaccaaaacctggaaattggtggctatgagttttaatttataattatatgaagacaaagcttggaatgctgagtactttttcttcaatgctgctcactgcccagaagcgttcagaacaactctactggagccattctgcttgaaggaggataaaaatgccaagatcaagtcttttaaagactctatcccttttcatcggaaaagcactacaagtttattctacagaagtggacaaactgtggaacttgatccatactgagtaagtatggaagactgttaacttggaggatttttctctgctttctaaagaaggttcactgctttacactcacctaggttctcatgagtattgctagctagtgcgagtttgatctatacttcacagacttttaacaccccgttctttaagttttccctgattatcaagcggatttccaattcttattccccactatcgcacctttcttatctgaattgtatttttgagtggcctaactgtaatcttttattttgttttctaattattgaaggcggtttctcgaaacatttcacgatttccaaaattcaagaattgaaattatgaacatagaagacaaaatgccttttttatcaactattatgaattctctagaaagtggttgcaaaggaaataaatatgtatttgctgagaggaaaagtttggaagaacaaaaagtatttctttgatggagctgattatcaagcattctttacggggagctttcgaaattttttatattcaaggacatttatgttgtgtgggttattaaacgtgggactttggaaatacatccaagaagcacaattgagctctaacgatgaaccgttaccataaagatagagacatttcttttgacttagaagctacatggagtaccaactattaatacacctctcctagagaacatttttaaaatagaataaaataaagtagcgctctcaactacccttacacttttttccttcatatctggctagaaaagagggattacatctcggaatcaaagttttaatactgctactacgaactggttacaattctatttttatcatacacgatactttgaacatcaacttctctcaataccatcgccttcagcggctacaattacgtaattgcaccaagcattcgccgagagtttacatatttgcagaccctaacagtatacgactcccaacacacgtttaatgttgtacgaattcaagagatggaaatatttcttccgcggaagccgtttaaagcagactgaatttaggcttagacaataagcttctgaacgagggtccaaatctaaaattcggatattctttttgaccgaaagcggaaacttcacaggcgcgcgtaaaagggttttgcaaggcaccccggcacccctataattggcattcccacattctgcgcatacgaatacacatgagtgccataaaacaatactccacatacgaaacctatgaaagatgtatgattcgttcagaaacaagagcatctccatagagataatgagattgtgtgaaagatgagatatggaggatatgtgaggtgctaaatgagcgtctgttaacgaatcgtttaagtagtgatgacagatggaggaacgggtataaatagagctgcttcaactatatgcctttgaggtatgcgctttcatttcactatttcttgttaagattacatcagcactaacaaacaaaacaaatacaatggtcaaattaacttcaatcgctgctggtgttgccgccatcgctgccggtattgccgctgccccagccactaccactctatctccatctgacgaaagggtcaacttggtcgaattgggtgtttacgtctccgatatcagagctcatttggctcaatactacttgtttcaagcagctcatccaactgagacctacccagttgagattgctgaagctgttttcaactatggtgacttcaccactatgttgactggtattccagctgaacaagtcaccagagtcatcactggtgtcccatggtactccactagattgagaccagccatctccagtgctctatctaaggacggtatctacactgctattccaaaatagagacatgcctttactaatgaacttccatagacattgaaaaataacgaaagaataaaaaaaaaatctttttttttttttgatataaatacagttgactatataaacatatatcaatactataagcctatatttgatcaagacgacattatttaggtgcatcaacaacggaaaagaaactttcttctaggctatccttctggggaagcagttgaaagtgctatccagtattattgcatatattcttaatgagtagtgctgaagtttgatacgtttggctctgttgcttttatttctcccacgaaaataaattgatttctttatttttcagtgtgttggcccggagttgtttacacacatgtctctttttggattaatgctgtagatcagggactatgcgagcgacaagtcagagtaaccatattgaatttttcgtctcctgttatacgaatatttgcatttctgtgcctacttatgtgtgtatatgtttttattagtcagaaaatggagtaagtgttaaagtaaggatagtgttaaggaggtaataactaaagatttgtaggataaggcggtgttatttgttgcaattttctcaggggtggagtggaaatggtttgattcaattatcagttaagcaaggaagagttgaagggcgaacatttgcaataatcccaatgtcatttaatgcgggtcggctgagacgctcaatattcggccgaaaagtatcattcggccgcataataaaatggaatagaagataaagcagatgtcactaattgagcaccaaaactctgagtagaaattatataaagaagcacgaacatgacctgctttagatgttgcttgatattattgaaataaaaaaaaacatagaaccactgaaaaatacaaaaaaaaaatgctttacccagaaaaatttcagggcatcggtatttccaacgcaaaggattggaagcatcctaaattagtgagttttgacccaaaaccctttggcgatcatgacgttgatgttgaaattgaagcctgtggtatctgcggatctgattttcatatagccgttggtaattggggtccagtcccagaaaatcaaatccttggacatgaaataattggccgcgtggtgaaggttggatccaagtgccacactggggtaaaaatcggtgaccgtgttggtgttggtgcccaagccttggcgtgttttgagtgtgaacgttgcaaaagtgacaacgagcaatactgtaccaatgaccacgttttgactatgtggactccttacaaggacggctacatttcacaaggaggctttgcctcccacgtgaggcttcatgaacactttgctattcaaataccagaaaatattccaagtccgctagccgctccattattgtgtggtggtattacagttttctctccactactaagaaatggctgtggtccaggtaagagggtaggtattgttggcatcggtggtattgggcatatggggattctgttggctaaagctatgggagccgaggtttatgcgttttcgcgaggccactccaagcgggaggattctatgaaactcggtgctgatcactatattgctatgttggaggataaaggctggacagaacaatactctaacgctttggaccttcttgtcgtttgctcatcatctttgtcgaaagttaattttgacagtatcgttaagattatgaagattggaggctccatcgtttcaattgctgctcctgaagttaatgaaaagcttgttttaaaaccgttgggcctaatgggagtatcaatctcaagcagtgctatcggatctaggaaggaaatcgaacaactattgaaattagtttccgaaaagaatgtcaaaatatgggtggaaaaacttccgatcagcgaagaaggcgtcagccatgcctttacaaggatggaaagcggagacgtcaaatacagatttactttggtcgattatgataagaaattccataaatagtctatatacgtaatatttttcagaatctcttaaaatgcatgtcaaatctcggaatttatcatgacccattacataacaagagaaaagtggtttgcattgtatgtataccttaaaccaattcttcggtagtcacatgacctatatatagggacattcatttcttgaataggatatttcttaaacttaagggaaattttgatgaaaatttagaatctctcgacaacagtgcagagcagtaagttttattcaatacgaaatgtgtgcagggttttacccattcatgtcgagtacgtctacatttgttctgcgatttaacttaatacttagcctactcatatgtatcgaagccaaactattaaatctgaaaactgaatacccattaagtaggtacattaatgcaattttcgtccgaaaggtagagtgttaatcatgcttttgcttcgaaatctagagtccgagcatgtctgatgaggtcctcttaaagcacttcaattttaaaagagaagagcgcaaatttttacaaagaatgcctatattaatatactgtgctatctaagaggatggttcaatggtttgaaatgagttgaaaaataaagatttacatagtagcgtgtattcttcacatttttgcattcggtagattttctactcaagacccgtgcagatcactattacactcattattacaagtcattgagaacgaaattttgacatcattactaataatgttactcattaatactttattaatgtaagcggtagataaacaaatgaacatgaaattggctgctgaaatgctctgatggattcgattacagtaaaaaaacctcggttaagattggtttgcctgcaatgcaaaaagatcaaacggaaatgtgataaactgcggcctgcttgctcgcgatgccaacaaaattcattacagtgtgaatatgaagagagaacagatttatctgccaatgttgcagcaaacgactctgatggattcaattcctctcataagctcaatttcgaacagcaacctgtacttgaaaggactgggcttagatattccttacaagtgcctgaaggtgtcgttaatgctacgctgtcgatatggaacgccgaagatatgctagttatagtaggattagttacatttctggattatccttttgctgcgcatagtctggcgcaacatgaccagtatatcagggcactttgtgcttcgttgtacggcatggcgcttgttgactttagcaattatgctaatggtattccttgtgaagacacatcaagaagtatactaggaccattgtcattcatagaaaaggccatttttagacggatagaacatagtaagcaatttcgagttcagtctgccgccttagggttattatacaatgcattttcaatggaagaagaaaacttctcgactcttctaccgtcactcatcgctgaagtggaagacgtgttgatgcaaaaaaaagactgtgaaatacttttgaggtgtttctatcaaaatatttatcccttctatccttttatggacatttcactctttgagagcgatctcactagtttgcttttacaagacgacaataatcgttggaaaattagtactgaagttaaaaatgtgcgcaaaaaaatagaaactttgtcattacttacaatagtaatggccatggccttgatgcattcaaaattggatgcaaatcttctttcaatggtaaaagaaaatgcctccgaaagtgccaggaaactttctcttttatgtcataaactattatgcctcctggatgtatttcgctatccaaatgagaacacttttacttgccttttatatttctacgtttcagagcatttagatcccgagagtcccgattgtgtactgagccccactaacttgcttactctgcaccatcttttaaatttgtccatgaccttaggtcttcaatatgagccttcgaagtacaaacgtttcaaagatccagaagtgataaggcagagacggatattatggttaggagttcagtcattactttttcaaatttctcttgctgaaggtgatgctggtaaatcaaatagtgaatatatggaggcatatttaacagacttcgaagaatatattgaagcttcctcagagtatgaaaaaagttctgcgagtgaatcgaacgtgcaaatgaatgatattgtttggaataagtacaaatttcacgtcattttgagtaaactaatgtctgattgcacttcagttatacaacatccgcagcttttccacattttaggaaatattaaaagatctgaagattttatggctgagaactttcctacaagttcgatttaccaaccccttcatgaaaaggaaccaaatgcgatcaaagttggcaaaagtacggttctcgatgtcatggatattcaaaaaactgaaatatttcttacaaatattgtgggaagtatgtgttttttaaacatttttgatgtcctatcgttacattttgaaaaaaaatgtgttatgcactgggaagaatatgaaaagaactatcatttccttactttgaaaagtttcaatgcatacttaaagctagcagggttgatatctgattatctcgagaataagtttcaagggaacattttagagagtcgcggttatatcatagataaacaaatatgttttatgcttgtaaggatctggatgttccaatgtcgtattttgttaaggttttcatacaagcaagaaagtcagaaaaaattggcctcttccagtatatccactaacgataatgaaaaagaagatgaaatgattgtcattttagaaagacttattaaacacattcgtaaccaaatggcacatttagtggatctagcaaagggaaaacttcaagatagttactttggtgcttaccaaactgttcccatgtttagatacgttgtgtatttgatcgatgttggcggcttagtatctgtgacaaatgggttttgggataagatttccagtgatggtgaaataccgccaaaagtacaacaagccgtgagattgaaatggggattggactgcaataattcgagaagaatcaaacaaaagttaataagcagccagagtttgcagagtttcaatcaagttctgttgtgccagatggaggatgcagttctctccagttccttcgcaataaaagccaataccgctatgtcccaaaacacggctgaagaatttttcaatatcagcgaagaagaggctttaaatcaactattggaaaacaacaattttgatgccttctgggatttattaggtgaaaatctgagcgatatgccttctttgtgagaatacggatatttggaaaggctaaaaaaaaaaaaacaagccaaaaacaagaaacactgttatcctccacgttttttccactgttttaagactcgacaagacggaaagattcctcacatttcgcagtgtttcttttaacctgctcgtcaatttgaaaaaatgagcatggttaggcaggcggaatgtaataggtgcggtgcgtataaataagtatctcggccgttcctctattgcgctcggccgagatgtcctacatgcataaaatagattaaaaaaagggatcacgatactcaaatatgcatataataacaacaacacactttgcggtaaatagaaggataatatcgtaatcttttgctggtttcgatgatgacttgaaaaaattcaattactctttcgatcatctagaagaagcatatccatcgtgcttaaaatgattgggtccgcgtccgactcatctagcaagttaggacgcctccgatttctttctgaaactgccgctattaaagtatccccgttaatcctaggagaagtctcatacgatggagctcgttcggattttctcaaatcaatgaacaagaatcgagcttttgaattgcttgatactttttacgaggcaggtggaaatttcattgatgccgcaaacaactgccaaaacgagcaatcagaagaatggattggtgaatggatacagtccagaaggttacgtgatcaaattgtcattgcaaccaagtttataaaaagcgataaaaagtataaagcaggtgaaagtaacactgccaactactgtggtaatcacaagcgtagtttacatgtgagtgtgagggattctctccgcaaattgcaaactgattggattgatatactttacgttcactggtgggattatatgagttcaatcgaagaatttatggatagtttgcatattctggtccagcagggcaaggtcctctatttgggtgtatctgatacacctgcttgggttgtttctgcggcaaactactacgctacatcttatggtaaaactccctttagtatctaccaaggtaaatggaacgtgttgaacagagattttgagcgtgatattattccaatggctaggcatttcggtatggccctcgccccatgggatgtcatgggaggtggaagatttcagagtaaaaaagcaatggaggaacggaggaagaatggagagggtattcgttctttcgttggcgcctccgaacaaacagatgcagaaatcaagattagtgaagcattggccaagattgctgaggaacatggcactgagtctgttactgctattgctattgcctatgttcgctctaaggcgaaaaatttttttccgtcggttgaaggaggaaaaattgaggatctcaaagagaacattaaggctctcagtatcgatctaacgccagacaatataaaatacttagaaagtatagttccttttgacatcggatttcctaataattttatcgtgttaaattccttgactcaaaaatatggtacgaataatgtttagataatttttcagtaatcaactacgcaagtaaagcagtaaatacgttactgctggtattaatgtcatgtattgaggcaatgatgctatgctcttaacgacatgtagcttacaaaacgttcctatggttttactgcatggtatttacaaattagatagcagttccatccgcccttgacatattattattcagacaaggtgtatatgagcataaatatgtatatatgcacatgaggtttgtattaaccttgcaactgtaccaaaatacaatcttctttgctgctatttaacggcgtatgtgcagttcataaatgcgtgttctgtatagtacatccgcgcacattcttcctagcggaagacatattaacgtagcccgtacgccctggttaagacttggtatagttccaataattggaatattactgcatagtggtccaatagcaggatttagcataaacatgataatatttagagatgctttcatccctctgacgaaggtggtagagaacaagaaaatgaataacattatatcatattcctatatatatatatatatatatatatatatcatataacggtggaaaatcccggcgatattacagataaacattacacccgcatgaatgtgagccactactatattataacttagtgaataaagagtgttacaatagtgaggtgcatattattctaatgtaaggtctgtataagtacgaaatattctgaagtggcatccagtcaagcaaatggtaatattaaggaacttttaagttaatgacgtcatggtagtgctcgtacttcaagtcaaagtgtttatgtattatggttgaagaatagaatatttttatgtttaggtgattttagtggtgatttttctgtaatattgacataagtgtatataaattaagtggttagtatacggtgaaaaagaggtataacgtatgtattaagggaatttatacgatatttgggcccgccgaatgagatatagatattaaaatgtggataatcgtgggctttatgggtaaatggcacagggtatagaccgctgaggcaagtgccgtgcataatgatgtgggtgcatttggtactgatttagtgagaatgggccatggattggagtgtgagagtagggtaacttgagagtggtatatactgtagcatccgtgtgcgtatgccccatcaatataagtgaaggtgagtatggcatgtggtggtggtatagagtggtagggtaagtatgtatgtattatttacgatcatttgttaacgtttcaatatggtgggtgaacaacagtacagtgagtaggacatggtggatggtagggtaatagtagggtaagtggtggtggagttggatatgggtaattggagggtaacggttatgatgggcggtggatggtggtagtaagtagagagatggatggtggttgggagtggtatggttgagtggggcagggtaacgagtggggaggtagggtaatgtgagggtaggtttggagacaggtaaaatcagggttagaatagggtagtgttagggtagtgtgtgggtgtgggtgtgtgggtgtggtgtgtgggtgtggtgtgtgtgggtgtggtgtgtgggtgtgggtgtgtgggtgtggtgggtgtggtgtgtgtg

(The sequence listing continues in the following parts.)

The invention claimed is:

1. An array of probes on a solid support for detecting gene expression, wherein at least one probe comprises at least 18 contiguous nucleotides of SEQ ID NO:12,223 (NORF 5), wherein the array comprises at least 100 probes, wherein each of the at least 100 probes has a sequence that is different from each other sequence.

2. The array of claim 1 which comprises at least 500 probes, wherein each of the at least 500 probes has a sequence that is different from each other sequence.

3. The array of claim 1 which comprises at least 1,000 probes, wherein each of the at least 1,000 probes has a sequence that is different from each other sequence.

4. An array of probes on a solid support for detecting gene expression, wherein at least one probe comprises at least 25 contiguous nucleotides of SEQ ID NO:12,223 (NORF 5).

5. An array of probes on a solid support for detecting gene expression, wherein at least one probe consists of at least 18 contiguous nucleotides of SEQ ID NO:12,223 (NORF 5), wherein the array comprises at least 100 probes, wherein each of the at least 100 probes has a sequence that is different from each other sequence.

6. The array of claim 5 which comprises at least 500 probes, wherein each of the at least 500 probes has a sequence that is different from each other sequence.

7. The array of claim 5 which comprises at least 1,000 probes, wherein each of the at least 1,000 probes has a sequence that is different from each other sequence.

8. An array of probes on a solid support for detecting gene expression, wherein at least one probe consists of at least 25 contiguous nucleotides of SEQ ID NO:12,223 (NORF 5).

* * * * *